United States Patent 9,677,139 (GENETIC MARKERS INDICATIVE OF A CANCER PATIENT RESPONSE TO TRASTUZUMAB (HERCEPTIN)) - sequence listing, part 7

SEQ ID NO: 1 - DNA, 15429001 bp, Homo sapiens (residues 13,224,859-15,429,001 of 15,429,001)
cttaaaacttctgcttgaaatgcatgttttgttaagaacattagatatgcaaagtattttgaacggaattttgatgtctttattaatagcatttaaaagttttaggatttcagatattcatagattgtattctccttgatttgcaaggtcatatattttaggtctttatatttctcctttaggaaataattggaactgtgaaggaaactgggaaaagaaaaataaagaaataattatatgattaataacaattttatcttttctcagagttattggaaagtgtattttatgtaagatatatatatataaccacaaatatcagtaagcacttacctaaaaccgattgtatatcaatcgtttgcctgtgagctgtgtaacatacacatgtcttgccttccaggagtttgtgatctagtgaaatgtgtaaaaatatacatgtcaaaggagtggcttaagtaccgttagagtttagagggggtaaacaattttttcttcctgtaagactttatgtctgaagcgggatttgagttgaggaataaaggtgatacataatagtaattcgtgataaaaataatattgaatgacaaattcaaatgcaatatttgttttattaaatctaagcaacttaggttggatataaaaaataagggtggaagatacaaaataatccaattacagcagatgcctttttatagctatattttgtttcatgctaattgaaaaattagaagcagaaaaactctgttaattagtactttctttagtttttttatatttagttttacctcttctatgagtcagcatttatgtttatccatatgaagagattgccaaaaaatcgtgacttaaacatacaggaattgattttctcacttaaggcaaatcccaaggcatagcagctccatgatgtcactggggtttctttctagccctttaaccacccacccctgtggtattgaatcaagtccaagacagcacctggagctccagtcatcacatctctcttccaggcctacagcaagaggaaggaacaaagaagggtgccagcccttccttgaaggccttaaggaagtaccacatgctgctttgcttatacataaccagtggccaagaggttgtcaaatagccacatctattacatggaggctggaaaatgcagtcttctagatggatatggattgcccagactaaggacagggtttggtggtagtggggaaacagaggagcctagtgtaggcgtatggcgtttctgtcattcctgctaaacatgtttaaggttcctgatgcacattgcggtgttactaatttgaaacgagacacctgacataagggctgtcactcactgggtggatctattgtaggcaccagacatattgttcagtccttaggaaggatccacccattctagttgtctgctcagatgaagatcatgaaagaattcactgaaaatgactgaacctagtttgagaatggtggtcatctggctgtgtgtttaacttatatacaaggctgtgtatcattatattcgggtgaatggataggtaggtatgtatataggtaacatattgtataattaggttgatagaaaaatggggggaaaggaaagaaaatgagggggcaggaaaaggaagggaggagagaagagggaggaacggaattggggaaagttcttagcagtacatcaaggatagtctggtctatggtctaatcaaaatatatgtctgtgtattaacctattcgactctttagtttcatagtgtagcacatcattctactctgggatgctgttttggttatgatcttcagtgtttttggtagttgattctttatttccacacttgtaaatgctgagagtttaccttaaatactcccaaagaaactttttttcctaatattttataatatgttgtcttccttatttatttcttaataagatgatggctcatctgtctattcattcatctatctatatataatccttccgtctgtctatatacctattcatctatcatatcatctatctatcatcttcccatccatccatccatgcgtgcatccatccatccatccatctgcctacctacctgtctatctacctatctgtgtgtctatctacctacctacctacctgcttatctatctttctgtctatctatctatctacctctctatctatctatattatgaatgctctttgtctattggtctatgacctaatcagtgttgtctctgttcttggcagctgcatttctcatctagtggaagggtagagttctagtctattctcttttcacagttacagatcaactccttacttagtttcagatgaaagtgggattgccacattgggtagctccatgatactgtgtgtgttatcccagtaaatatctctctggcatagaagagcaagactgttactatttgatgagtccatgtgcagaaatatatgggtcaacctacagaaatcaacactgtcaagtgacataaattcagaagaataatattccatacaatttgtataatgaactgctgtttttgagaaatcattacaggcaaaaagaaagaaagttgggggagggagagaaagtagagagagggagggaggaaggaaggaagatggaaaaaagaaattctctgagttttcagtggaagaaattacctccaaccacatttaaaatgttttcaatgaccttcttaactgattttgagcactggaaatttctcatttctcccagcaatagctacagtctactaaacactaggtagaactgacagaagcagtgaaggaaaattgctaccaacttagagaacaaggtgcccggctactgacactgctcgtaatctcttctcatgggaaagtgtttaatatctacagtaacatttaaatttgagaagacatggtttttaaaattcatatacagcaataacaatagttaatgaggtaaattttattttcttcaaaatatcttgtatccctctaactcatggaacgttagagatcactatggagaagccccagatgtgactcctgtgatacttagaagagaccctgaactcttattccctctcataaaattagtagacacacttgtggcacttcgttgattgctcagtccaaagtgatctgtcaaaaatcagcacctgcaagcgtcatgcacataaaagttaagaaaaaaagtgttttttttaacatgttcagattggattttaaaaataaaataagtgaacttctttttagtgtgtctaagttaattttccaaaattcaactcttgcatagtcaatggggatgggataaatattatgggattttcatttgcattgcccttcctgttctctgaaataatttattataattttcatgagacttcataatattattcattcacttcataattgaaacgttgttaaactctgcctcatgttgattcctgacctataccagccaaaggcaccttcctctacttcttctctcctttctaaggaagttagcaagtttgatatccactgataacctatgcagatgattgtggtcttattgatttataaaacgaagatgatactcctgacttcttagaaatatatgttagattaattgataggaaaattgtttaaatatttaaatatgcaaatattaacaaatatgtaaatatcaataacacatgcaaataataaatatgcaaatgttaattaacaaataaacatatgaatgttaaccattaaaaattgatacagaaaaaggtttaaaaaagacatagaggaattaaagtgtgattatcatttcatcaattggtttatcattttgactgatatattgttaaaaaatagtgacaacttattgtattcaagtttattacccaatttttagtaacatagtaaaagtagtgaatatggtgatagtgacaagtcatagaatgcaggaaaattgtcaacaactacaatagtccatggcactttagtagctgctaaaaaaaattatttggtaagctctaactcctaccctttgaaaacagatgagaaaaaaatatatagacccttactttagttaaaaattcatacaaattcacaaaggaattccagttcacctggcaaatgacaagcccttctccttgtgacaaaatcaataaaatctacaaagcctatgtgcagggctcctcctatgaccaacttccaatgccagcccccggggctctaatagaggtcagatcagttcttctgttcctgaaacataggagtcatgttttgggttttacttttggcttatcattctgttatttgacccaagctcatttgagtatgtaatgagaataactcattgagctaatatattataaaatagcctcagacttgaagctagaattctgggggaaatcccaagcatgaaactctacccccaacctccaccactctctccatttaaggataattcatctctactttaactccacattccctggaagatttattccctgcccacctgattacaagaatagcacaatttaggatacccttcgggaatggagatttaaaaatcatttagaggcaagtatgatgactcaatcaattatgttacttctcaccaattttctaaacctagcaccaataagaagaaagagactcagtgaaagtaattcacaaggacaagttaaagaaaaaaggaagttaaggggaataagttaaaataagtagttcagaagacagacaaaatgaacatgaatatatttattcatgtcttcaagttcattttgtctgtcttcaaattatcaggaaaaagtgatatttgaagttagaaagaaaggattcatatttgttgaccacatatcatgtacaaagcattattccaggtcctgaaatatattcgagatcttgaaattgatctttgtttttgacccccttggcttattttgctttacttttattagcattagtagcacatattaaaactgtcacaagtcaatgaaatatgagtgggactgagtgtgtttcctggagacttacagaactatgacagagacaattccaaaaacaaaaagtgccagatattaacccttgggttgcctgggttttctaacattcacagccaaatgaagtggttgcaaaaattgtaacatgtaagctgaacaattgatatatttatctccttactgggcatctagaccataaaaatctcctactttttagtttcaaacttttaatgacagtcttctcaattagaattattttctgcattattcctcacattcatgcaacttccgtgattttgtaaatttttgattgagagaaaaatatgcacaccattcagaaagtcaaacactgcagggtgaaaatactcaagtgtaatttcaagttaattctggaagttcaaggttttagtaaaaagaacatatgttttcaagggcttctgagtcccccccgttcgcctgcagagttcggctgcaagaccctgactctccaggctgtgacttcattatgaggaaaaccctttgtagagggcatctgctcgactctaataataaattttaagggaggtgcagaatcaaaatgagaagcaaatggattaattattcctctacatgggagctgggaattcattcatgacgtttgttcctcatcactttgtgtactcttggacttctgcaggaaggaagtgttaaatgagaaatgaaaggagtgagcctttattttctcaatgttggaacttccatttcagtgttccagaagggagaactgttcttagcactggggcctgcacagtctgccacataggcccacttctcagaattagagggtgaagactgatatacaggggtgtccattctcaagtacatcatagttcagctgtgaaaacaaaagagctgggtttttaaccctgactttgaccctcgttagttagacttcagacacctggcattgaagaccttctttatcaaatcagaggattaaaaccagttactcctaaggtctcctctaattctaaactttatatttccataaaattaattctaggctttggctgctagaaaggacttcagtaataattccgcagtccactcatctagtccaacactttcttctaaattggtccaatggattgagttttgaacattggaaatgggagatgtaacctgtagtcacaagcatagaagtaatgacttataatcatcagattaagctctcaaaaggtatgattaagagaaacaagccaacagagtaggcagtgatttcaaaacaaccaccattgtcaaattaacagcagcccatcctggatagaataatttttcagttgtaatttcaattttttcaatagataaatattcctgcagattgtccctattcaaagtaatggcatgttttgtgtttcattttgtattcagaagcagttgtgcttattaaatattatctgtttttgcaattaatcttttttttttttgcttcttaataactggtttagttcatctaacatttgaaatgacgggtaaaaaagcttattactctgaccgaattgtaaactccccaagaggagagaccaaggaactaataccaaagcattgtgctaagaacctgtgtgggtgcacacgtgtgtgtgtttagttgaattgaagagaggtccaccaactcattcaaatcgtgcatgttagccatgctctacaaacttaatgagtatacccataatactacataccatgtcactgatccaggtatttttatgttgttatgtatttacagcccacctcttttcacaaagaattggaggcaatgtacaatttttttgttgttgttgaggcggagtctcgctctgtctgtcgcccaggctggagtgctgtggtgcgatctcggctcactgcaagctccgcctcccaggttcacgccattctcctgcctcagcctcccgagtagctgggactacaggcgcccgccaccacgcctggctaattttttgtatttttagtagagacggggtttcatcgttgtgttagccaggatggtctcgatctcctgaccttgtgatccgcccgcctcagccccccaaagtgctgggattacaggcgtgagccaccgcaatatacaatttttacatcccacagtgaaataataaactataaatagaagtagaagattaatggcaggaacaaggagaatagaaatatgccaatcctaagatgggtctggttgctgaacatcgtattttgtttgagctttctggttgccggaagaaagaaatggaagcgtgttcagttgcaaggttccccattaatgaatgggaggctgcatcctggtccctcggggaagtaacaagttttgataaatacattaaatagttgtgttccccggacaaaaccctgtggaacaattctcattatttacatggaactctagatgaattgataattttttcgtggcatactgataagtttatctggcaattggacgtcacatgaaactttctatcccagaaaaccagtttatgtggctaccctggttagttcaaggtctcctgtcttgaatatctaggaataatgcatgctaaactgacttgaattactacgaatttcccgtttatttctgaaatttttctaattttaatttttattataataaatatataatgtaaaatttattattttaaccattttaagtatagaattcagtgacattaagtatattcacaaggttgtgtaaatatcaccattatttccttaacattttcatcatcccagatggaaactgtacccattaaacactaacttcccattctcactgtccgcagtcccaagtaacctctattctaccttctgtctctatgaatttctctattctgtgtacctcatataagtggaataatacaatatttgtccttttgcatctggattatttaacagcataatgttttcaggttcatccgtgttgtagcatgtatcagaattttatctctttcgatggctggataatattcaattttatccctttcttttaaaaaaataatctaatcttttcagtctttagatttttttccctgttccttgagttgtcaaaatactagcaaaattatctaaaataacatctgcctatctcttaaaaagccctacaattcaaatcattgtctcagttactttgctgacctcaaggttttcctttgatactattcctttatctattatgatttgatttgagactttcattgcaagcaattttccatatggaaaatgttttcttaatttttataaaaatttttggaaatgtttttatggaaaacattttttaaatcttatttttgtttctttgtttaaaaaattacactttctagatcttggtctcaaaggggcgtcatgtgaaatttttcttaattttcttcattgatcaatataactatcaaatattttcacattgctttttgtataatgtataagcactacaagttgtatctattttccccttgttctgagcagctacttacttcctgagaatgcccactagcaatcattgaaattttctcgctcagtcccacagcctaagcaaaaactatacaaaaagttcaaaaactttaaagagattcaagtttgcttgtttgttttgagacggagtctagctccatcaccaggctggagtgaagtggtgagatgtcggctcactgcaacctcctcctcccgggttcaagtgattctcctgcctcagcctcccgagtagctgggattgcaggcatgcaccaccacacccggctaatttttatatttttagtagagacagggtttcaccatgttggccaggatggttttaatctcttgacctcgtgatctgcccgcctcggcctcccaaagtgctggaattacaggggtgagccaccgcgcctggccgagattcaagattttaagaccattgactagaatttaaacaacacaacctctacttgagcatgaaaaaaatcactcccatagctacatgttcgtttcatttgactcatataaaaataattcatagagaccaaggtttatatcaaataacatcttaagttgaaactatcaattcaaaaattaaatatttcaaaaattaaatgccacttacaaaatactgttctattaggtatacctatatctcataacatgttaacaaaataatatgatgtattttcactgggccattcttagagataaaacattcaaagaataaacttaatattaaaagctagttaatcttctgaatatggatttgaaagtgcagtcccacacatgtgtttttaggcaagtcatatcttgcctaacatttcaataggtagatcaacctgctggaaaaagatctggcagcattttctcctacgagttttttcgctgtggtttttcttgggttttttttttttttttttttttgagacagggtctccctccatcactcaggctgaaatgcagtggcgtgatcgccactcactgcaacctccgccttccgggttcaagcaattctcccgcctcagcctcctgagtagctgggactacaggcgcgtgccaccacacccagctaatttttgcattttcaatagagatggggtttcaccatattggtcaggctactttcgaactcccgacctcaagtgatccgcctacctcagcctccgaaagtgctgggattacaggcatgaatgagccaccatgcccggcctctacaactttttcttcattaagttgtgctaaaaattttgaaagtagctagatattaaatgaactacaaatgtattttaatttggaagcaaacttttgagataaatattggttcaatacatgaaaatcattaattaaataacatttaaatcacatggattcttggcattttctctggattctctatttcacccagtgttcataatttatatgtattctacatatctgatattatatatgatacaaatcaagtgtattttacatatgcacatgcacttaatattcagctgtacattaccatcattaagaaaaatctcttaggtttttttctaatttcacaagccttcatttcatattcaaactaaaacttagaagtaattttaaaaatttggtttaaaaatcttacattgttactggtttaattttgatattacaccttactaataaactttgggttaatcatcagtttcaattcagtttaattcagttttaattcagtgatatttctaaattggataatgaatatctgacattattcctagtgcctgacacctgcttgaatgtcctttaccatgaggaaagttttccattgagccaacgtaaataaaatctgggagctagagaaaatagctaccttgacgaaacttggctcataagaacccagcaaatactttaaatactttcctgttttatttcatgagttcttctacagtgtactttaaaaagtttttcttcctgctcaccttatttcccctaagtgccagtctaaaagactgattataatgggcattagaaacactagaaaaaaaaatgtcctttctgagccccagattctaagcttcagttactggtcgggtcttcccaaattatatggctatctttacacgtacctgtgtgattttttttttttagataggacattttacagccagaacccaaacttacagtatgcattaaaaactaaatgtatttacaaggctgttaatgtaagcttaatgatagacttgacaaaatacattagatttctaatgactatttccaatttctctttattaggaaagtaatgatacctttaatctgttagtaggtggctacaggagtattctggttctctttttttccgtttagttctcttcattctctttctttctctgtgcctctctatccagtcttcactggagtgaatgctcccttgaatcatgctttatattctggctgcaaccacaactgtttaaaatatttccaagggcatttgccttcttccgacattcttcacgacaaaattttaagttcagtgcttcgtatctgagaacagtgtctctcttctgcacacgctctgatcagcctctcggactccaggatacattggataattgtatatcccttggcattttaaagacgagatgcagcttcaaaatggggaacaacctagaatagcctttacaatagaaaaatcttgaattcaaatcactcttcctccttaaactatcaagcatattcccttgattgaaagacctcaaggatttaacttttggctatttcattcctgcaatatattcactatatatgtacacatgagaaaaaaggcaagcaataaaaatcagacacaataatcttaaacagcttcccagatgaggctcaattttattctattctattctattctagcctattgttttattttatttttttgagacagagtcttgctctgctgcccaggctggagtgcagtggaataatctcagctcactgcaacctctgcctcccaggtttaagcgattctcatgcttcagccccacaagtagctggaattacaggtgcccgccaccacgccaggctaattttcgtatttttagtagagccaggggtttccccatgttggccaggctggtcttgaactcctgacctcaagtgatccacccgcttcggcctcccaaagtgctagggttacaggcatgagccactgtgcctggccaaggctcaattttagtttgtcatttcccaacctgcacccagataaaccctaggcttgtaggtaaacgtttagatagcctgtgaaaagaacaaattcaaatcaggttaaattcactgtctgtattagtcagcgttctccagagaaacaaaaccaatagaaatgtgtatatatatatatatatatatgtatatatatacatatatgtgtatatatatatatgtatatatatacatatatgtatatatatacatatatatatgcgtgtgtgtgtgtgtgtgtgtgtgtgtggaaagagagagagagagagacttacaggaatagactcatatgattatggaggctgagaagtcccacagtctgacatctgcaaactggagaaaccaggaaagccggtggttcagtccgaaggccttggggcaggggtccgttggaggaggggggaacagtgtaagccacagttctagtttgaaggcctgagaaccaggagtgccaacgtccaagggcaggagatgtgtgttccagctcagacagaagaaaattcaccttccctccacatttttgttctatttgggccctcaagagattagtagacgcccaccctcactggggagggggatcttcctttgtcagttcacgattcaaatgttgatctcttccagaaacatcccctcaaacgcaccaaggaatactgtttcaccagctacccgggcatcccttagcccactaaagttgacatattaaatcaaccatcacactacacttacatggtgacatggtttggatatttgtcccttccaaatctcacaatgaagcgtaatgcccagtgttagaggtggggcccggtgggggggatattgcatcacagggcggatccctcatgaggggcttagcaccatcctcgtggtgatgcgtgcgttcacgtgggacctgggtgtttgaaagtgtgtggcacccccgttcccagcctgctctctcgcttccactctcaccatgtgacatgccggctccccgttcccttctgctatgattagaagctttctgaggacctcaccagaagcagatgctggcaccaccctgcccatagagcctgcagacctgcaagcagaaataaatcgctttttctttataaattacccagcctcgggtattcctttacagcaacgcaagaacagcctagcacacatggtatgctttttgaggctgtttttggcatacaatcaatactatttaatgatcgtggtagtcgtggtagagaagaggtgtgaacaatttacttgaacgggcaataattataaaataatcctcaaattagtgaggtgcttcaagactgctcttgctttgaacagcaaagatacagaaaactataatccttggaactgtgccttccattgtagtattttctggttgcattttgggaagagtgtggaaatcctaacatcctctactgctgacggaatctatgcatataaatgttaaaactatactccagtataaaataatttgcttttatttttcttcttcattattttaattaattgggatcttccttataagccaaaaatctgaattccactagctcttaatgaatgatacagaaaaatataatttctccatgaatgttaggttgattggaaaatgtcatcctctgacctactcagccttgctaatcaagagaagtcttcagagggactaatagttagattaagcaggctacaatccatcagccaccccctttatttgtttaaattagagtttctgtcaggtatgaggttcagtgtatctgaggaaagccatgccaacatggctgagagcatatacaggcatgtctctggtaattggatagtgtgctgtttcaccttaagctgttttgaattaatgcaagacatcagccaccagctttaggtggtttaattatcagaattgtcacattttagttatcagcccaaggggtgcatgctggggttgattgtgaacatgtggtactacctgatacaggttacccgatggccagatatgggtcacttcaggacacacttaatttaaaggagtactgtcctgatgcagaaatatttataaataggaatctggttttcaaagaaaaaaaagactactaaaatacaaagctgctcagttgaaagaagaaaaaaatagatcccttactatcttagctttatatataggaattatgctactattaaaaggtttctaaatgtcaatattcattgtgggcttttaaaaaaatttttgcacttaagattattaaaatcaagcaatttattctaacgtgttagactaaactgtgcccccactctattattagaatgaaatcacttcttatcagaagtgtctattatacagcaagcagaatatagtcttgttcattatttttacttaaaggggccccaaccatttgtatggaaaatcattagtgtctgtagggttggtgaagttttcagctctgtgtgtttaactgcacttttactgaaatattttagtgggttgctcaactacggagaatagtatcccaatgaccatcacagtgccctaaattctattgttttcctggatgctattgctttcctgaagcatcagtaaaaataatggaactaattcttctgaatcactgcactcttaccccagttcagttctaatagtattgactacaatctaagcatttttgcttcactcaacacagctcttaaagggctttctcttttgaaggcatactctctgtgggtggtcaatacccttatgaaattgtcagacttgaaagtaagatggattgttactggaacattaagtaggacagagagcagatgaaatttcaatacaacgttgcagctgttcataagctcaaaaacgtaaattagttcagctaaactgctaaattccaataagaaacaaactaaggagttggctacttgttccctaataggaggaaaatgcatctaaaacataaattgaaaccttgtcatcttaagaaactaacatttgcactaaattattccctccctaaacaacccagttaatctaatatttacaacccctgtatacaaatccagatggtctttcctaccactcagcacctgccatctctgcagcttttgataccgtgattccctccttcacaacctcttccttggcttctcttagccatcctaatacctttcttattttctctttctttatctcctttcttgcttctatttctaccagttctcttcagatcaaattctcagactttctactcttgctcaattttctttctttatccaaatccttagattgctcatccactcttgccatgtcaactatcacctatatgctcattattaaacctgcagtttcagcccatgcctttatccttcatttatttccagttgtttacagaacacgtccaatcaggtggtcatgtttgtaaagtcaaatctagtgtatgtgatgatcaaaaatgaatcctttgcctaactttttgttaggatctgaatgtgtaccctccaaaattcaagtgtggccagtgtgatagtatggcggaaaggggagaggttgtttaagaggtgatttagccattaagccatgaggactccttcctcatgtattggattaggtacccttcgaaaaggacttgacagagggaattcaaccttcttaccctttgacgttctgccatgtgaggacatagcatttgtccaggatagactggaggctcaccagacaccaaacctgccaatgccttgatcttggacttcccagtctccaaaactgtgaaaaataaatttctattctttgcaaattacatagtttgtgggattttgttgttgcagcccaacacagactaagacacttcctacttcaatgaatgtctccttgcttctatgaattgcatattctgaagtcaactttattgcatctctctcccatcccacactcaggtagccactgagtcctagtatatatgcttcgcaaagtttctggtttacttctccttcccgtgtcatactatggttactctaatttaccatcatgactttacttctcatttttaatagtagactacctagtttctgagtgtcaccattttatttaatggtggctatacaatagagtaattttcaccatgtattccatttgttaaaaatctatattagcttcttttgcatatttgaataaatttgaaagtttcaaccccacattaagggtccgtatgaactggtcccagtttactttctcgatcttggaacattcttgatgcatcctaagaggaattgtttcttgcctcttagagcactcctagccaccttggcccctcacatgctccgattcactcctagtcttttttctctctgtttctgctaaatcctacacatcgttaatactcagctcaaaattttccctctccatgaagtttgtctgaattaacatgagcccgcggtggtttttctcatgttctgaattgcctctgaatgacacatacaggctgaaactctctatacattttataggttgcttccaaattgttttctaatttatcatgaatatatgaatttcctctcaaacaagatttaacattccagaagaggaagaactgtgaattgtaccattttaaatgtgtgaattctaccattgaatttaaaaataactattcctagtttctgggatgtttccccaattcagttatttctaatccctgtgtgagtatcagaggaactaggtctttaatggcataatcagatcccatgtcaaataaatgacattaagagtgtcattaatataattccgtattcccagagatgttctggaaggtttatatgtattctcatttattataaatacattgaagcatgcttaaatgaaaaagactgaataaaaatgaatttaaatgacaaaaacggtgttccataaatgtaagaattaatgtctacattctcatgtaactccaggcaaaaatacagaacaagtggggttccactcatgaacccacactccgaacttgttttgcattattctgcccactaaaattataaacctatggaatagacctgaatgttaatttttattataatgttaacattatgataatatagctaataaattatagtcatctaagacacatttcaaaaatatacaggcaggcatctctacttccactttcccctgcccaccccccccccacccccaccattcctcttaggatgcatccagtattttgtggtttccaaattaggcatcaataaatgcaaagatttttacttctgcaatatcatctgtgtaatgtaaaattcattgacatttatatttgtgcttttatgaaactactaatcccaaatgaaatgttctcgtgaatatgcaaggaaaatgcttttgttagtatttggtcctgtttctacatttgatttgtatttggtttttaaatgattaatcagaataggagagcacagctttaggttaaaatgttttagcaacacaagacagtcccacactatacagagccatcccgatattttaccaaagcctttgaaataatttgtaattttttctatccatttaaaatatgtatattttagagaactatacacttagcaaagcatttttattgctcataaaactaccaataaacaaacatcaaacataagatgttgtgttttatatgtaggagggaaaaaacaggcttggataatcctgtctacatttttgagaagttgaaaaaaaaaaatgagttctagcaggtaagaagaaaacacagttttaaacctaaacacctgcaaagagaatgtcaccagctatgaggttctcatgtttttggataaggagctggtcttaattaataggatatgaggcaatgatgatgttactaatttcggagttcctaatgaaacagtaacactaccctttaacttaagcctacattctgatcatcattagcagtaatgatgtcatgagtaatggcactgtctaccgtaattacatgagggctagcgagaaaagtaagagcatgaaggtagctctaattctctcagaagcttgtgccgtggagacctacctgtactgctcggacttcacacacagatattctcatttacaggcctggcgtgactggcttcaccaaaatagttctctattatttgttggcagctgataaacccatcaaaaggtaaccaataagtaagaacttatttgaagagtgacattatcttactactgtcagggagtatgagcaaaacagccatcggtttatcgtatttataaagagaagaagtgattggaagtcgaactttttctttttttaaggtcagaatccttaatccaaagctgcagaagatttgatgtcttgtaaatggtcagttttatctgagatctggtgttaggggctttgccaagtcaacggtctccaagtcagtggcagaaaaaaaaaaaaacggggaaattagaactttctccagcttacgatagaatgatatgtaagaattcacggatgccacagagttaggtgtctgagcatgatttgcatccagttatggacgtcactggttgtaatgcatgcatatttatgcacacagtgtgcaaacggggctgatgtttataaacatgaaaaatattagaaaattcattaattagggtcatttgtacaattccgttgtcaactttaatcacttctttcaattgatgtctcctttagaaagtcaatccgccatagttatttatttattcagcaagaatattgtgtaggcctatcttctgcttgacctataatgttatttctaataacattcattcatttcattctaataagcaggaagttaggtttaacacattaacatacgctgttaaattaataaatacgtattaactgttggatttcattccctgtcagtggaaataatgtgtttgtattgtgtaagtatgtgtctgttgactattttttatcttttagtgagggcctaaacaaaattagtattttcgcaaatttaaacatctgtaaaggcttaggtcgttccatgaggcaaacaataagtttctttctgaatcaaactacgtaagataacctaattaacttatcattagctattccagtaataaacattatctcagcacacacagttacacagcggttctaagcaccctcattcagtacacactcgcgctcccagtcccccaatttttccatctttccatcttttctgtgcaactttctatctggctgattttttttttttttttttttttttttttttgagacaggatcttgctctgttgcccaggctggagggcagtggtgcagtcatagctcactgcagtcttgaactcctaggctcaagcaatcctcccttaccagcctcctgggtagctgggactacaggcatgtcaccacaacatccagctaatttttaaattttttatagagacaaggtctcactgtgttgccagagtggtctcaaactcctggcctcaggtgatcctcctgccttagcctcccaaagtgctgggattacagttgtgagccactgtacccagcctgattgtattctctatataaacctttcccctccaccatgcccgcctcaaagtttattttaattgtgtctccattggcaaaagtctgttatatacccaagcttcctttgactgtttaaaggtagttgattttcttcatagaacagactgacttcctgacattccccctgctaattgctttctctactgttattcctactgtgtctaaaatgtaagcactctgtttaaagagcatagcctttaataggctttcctccccactccacttactgtcaagttctgaatcaagggaaagtgggtatccatggaagagagcaggccctgggcttcgggacagtgggtgagtgatttgttgggaagtgaatgagtaaatagtcttattcccccaatctaaaagctagagaatttgttcaagatttttttttcgtttctataaaactgaccttaagtaagtcaattaatccttctagacttccattctgttgcctatgaaatgaaagtgttgaataagctcatcatgatgatcccttttaaaattaaactttgtgattctgagataccatacaaaggatttttaaaagaactgaaaagtcttactgaagttaagaacaatgttctcaaagacatcctggtattttgtaattaaaatttagcgtttgctcttcatcctgaaaggtgacagcaccagctttccccagatgcatctcaaagccaggtgggaaaataataagtgtgaaccatctgaagccatggtacactctaaatgcacacacatgagaaatgaggattctcacaaaaaacggaggcatgcattgaccactggggtgtatttgatgagagtggaagaccagggctcccttctcttcgttgctacagcagtgggcttaggtgttccgaaggaatgctgtctctcagtagacaccagcttaccaggccctcggccagcctctgcccagatgctccagctgttcctcctccacatagctgggctctgattaattccaggaggccttgcctggtagaaagaatctgcagcatcacagacctcttacaggatgagggctcaatttaaaccccaagatatgtctccacactgcgggagaccttcttcctggaagtcatctttcagaaactgaaattctattacccaccttgtgcagcctttgttgtccatcctagccctgaaaaagaactcctgcttttcaccctgacattcccttcctgaaaaggctcgattcctccatagggattcaccctagcccaattgttccttcttcccttcagcctgccagctccaaagctggctatttttcactagttctgcccccagatctgcagcctagcagttcaaacaaattattcagcacataaattcagcatttcaaacaaattattttggcacaaatgaaggggttagtggaatgggtcttattggcatcttccaatattcagcccattttttatccatacctcattgatttcagctttgacgcagatataaagacatactaaagagcatgaaatgtgttattagtcaaaagaagagctcctccatcattcttggctaagtgtatccaggaatacatttacaagtgactatccaattagtctcttctcaactaatttcatactaactaaaaggtagaacattgttccatttttaaacttggcattcttatgatactgactttaagttaaaatttagaagaaccttggtgttcttacagctttgcaagaacaagattcatagcgttgatcaaagattttgatacaaaaagcttatcatctacatctaaatctgaaagttagagatcactggaaatactgagctttatcttcttcaatttcaagtgtttgaggaaacactgttgggcaaggacagtttttatgctggccagtgatagtgacacacttgtgtaaacaatgcatttattaactgtattaatgttggcatcttctaatgccttcagcattatctgatcaataaatttattcattctttcttccccttcttttcttttcttattttaaacttatatggttatgcttccatcagaaatgggcttaaaagacttgctctgcccttattcactcattaaatatcaaaatcctcaccaaaactgccatcgcattagagcaatatcagagccatatgactcaccaacaattctatttctctatttctctaacaactgcagtcaatgacgtaggcaccattagaaattctttcttcctctgctgtaggctgataagatcaagtcaagcagctttattcacttcatgcaatccaacttcattgaaaagagaaaatggaaaaggatcagttcatactaaaaatactttagtggtacttcattgcttgtttttaaatataatctttgaaaaaaacagtagtaggtgagtcaacacatctgcagctacacacacacacacacacacacacctttgtgatatttctgtcaacagataataaaatagttacccaattccagtgttttattctaggtgtttttactgttttgttctacatttttactcgtctcttctatatttatatctaaagcctgttcctggtttatattttccattgattaaatttcctctgattattaacataaaggaaaggaaagtgaaggtggtctaagacccatcaactttgcttattcacattttcatgatcagtaaaatattctctggtcccactgaaatgtatactgctatatgttctaatcagcaaacttgaactccccccaactcattaagcttcctggcattcatctttctgaattaagatgtttgaaggttttcatataacccattactctatcagaccagacccctttctacatttctgttgggaaaatattctttgtggtaaatacctcctttaatatttttcatctgtcatgtgtgtgtgattccaagggcccaaactttctgcttgtaataatatttcaaaatttttaccattaaatgcatttcattcactatttttcaaagtaagtggtgttttgaagatattgcaattacatcttttatttcgttttttactgattctaaaaaagaacattctgctgaaatgatgaagcagttgctaaattataaggtagtctttaatgtattatttaacttttattatttaacaatttgtaaaacaaaagcaacaattttacattaccatattattcattgtaatagagatttttgttttctacattctaaaatatttatagtgaatattttcaaagatttaatctaaataccaataatttgggctaatgttttttttccagagaaaagaagtaaaaaccatgtgattttttatgtcacttttaatactgtctctcttcttcttttaacagtttttgaatattttgaactgaaagtactagattaattagaagactagttctaggtccacatgttatctcagaagttaaaagtaaaaaatcttgaggtatatattgtctttttatccttaagacttaggtaacagaatttaattttgtttttatttgcttataaatttaaaaattaaagagtatttaagaactacaagaactagagaaacgtagaaagaaaaatacttgatacggtatttacaaaaaagtgaaagaaaaccaacaacaatttttaaactaattttacccaattctttatgtgggttttttcttttatttgttttgttgttttgttgttttgttttttgttttgttttgttttttgttttttggggttttttttgagacagagtctctctctgtcaccaggctggagtgcagtggcgcgatctcagctcactgaaacctctgcctcccgggttcaagtgattctcctgcctcagcctcctgagtagctgggactacaggcatgcaccaccacacccagctagtttttgtatttttagaagagatggggtttcaccatgttggccaggatggtctcaatctcttgaccttgtgatcctcccgcctcagcctcccagtgtggtgggattacaggctatgttttttgtataggatcctaacagtatttttatcaactaccctggatattttattcttgaagtaaacctaattttttcccactgaccttttttcttgatttttaaaaattttaggacaaattttttaacctttcattttatattggttgtagtatttattgctgtaattaatttagcagagagatgttctcacacactcataaattcatgaaaataacaacttctatgctgaaatttttcacacttcatcacagcccaaatatgagtttatcttcaaaatttgaggaagatcttaaatcttcattgatttatgagaacattttaaaggcatcctgattgccaatgccaaaaatattttggcttcttgattaatttagattcaaaaatagcttaacttactcttcaaatttagtggaaaaactttccattaagagttttaattaagtaaaaatatgtcatctttaatcactttacctgattatcatcattcaaaagttcacaaaaacttaaaggaaagtaaataaattttggctcaagatgtattaaaataatattagttgaaaatcagtatattctttcacatatcatatataaatatggtccaataccaaacattcagcagttccaatacgtatatttgttgtttgtttcccatttaagatatacctatatatagctccagttcacaacagacatacctagagatttagaatttcagtcttgacttgaaactgaccctcttgcaatatactcttgaagtctccaagccccttgagtcctctttttccttcagtgcaattcaataaattcaattccacaagcattaattgggcctctgctctgtgtaaagcactcagtgtgaagtgcaacaaagaataggcttccgtctttctcctccgtgatttcaccacaggagagacctgctcccttcctttcccccggagcacaagagctgccagtagtatcgttgagaacagaattataacatctggatattgctagtttctttattctctctcaagtggcaaatcagttcaatgagaggcatctatttctgcctgagtttttgtgcacctgcccacatgtgcacacactctcatttccgtcattttctccaaggcaggtagacttccgtatttttaactttctttcagattggagcccaatttttagtacagagaggaaaccaatgatgctgacttgcagcaaaccttctcaatgatcaagggacaggaagaatttgacactaagcttcctcccaaaaatcatagcccttctataactaagaaacttctaatggtgtgaggtgccccaagtatattctacctctgtaccaaaaaaaatatatgagcctgtctgtcatgatgaatcaaaattactggatggaatcacatggccaaagtcacctggtgatgtcactcatggagtgaccatatccactactcacgccaccctagtaaggatcttgaaataaattttacaattcctctgccacaagggaaaaacccaaccaaaaccaagcctctagcctgtcctatggggctacccagaatgggatccacctttgaggctaaattcaatatctgatctcccaaacgaaaggaaaaggcatcagtgttggccaaaacagttgtttagatgagcctctgatcctgcctacaagaattattttagagatttccaatggaaattactcaatatgtcgtgagagtctatgagctttatgatctttcttccatggcatgtgctctataatatttgcagatatttactgaaaatactcacagctgaaagcccctaacacacccctcacatcagcacacacatttccactttctttccagctgcccgctaaatttaaaatcacagaatttcaccacaatgttttcccacttttggatcttgtttagtgtaaagttatggattaaaatataaaataccagcaaaaataccgggtatgtcagagtcttcaaattattattataaagtaaagttttatgtttttatcaagttttcacatccttcattcccccccacccaaaaaaactgcaaaaggattatttagcaagttctttttcccctcttctgtaatgggaattttcactcatgtgacttagataatatgtaacaaagaagcacattacaggactggatagtgttaatcgaattagagccatatgataccagacagaaacgtatggctttgcataaaaatctgggagtccatatgttctcaataaagaggtaaatgcgtgtgcatgtgagcatacacacacacacacacacacacacttatatacaatttggagataggtatatttgtatatcttaaaagagccaaaaaaaaaaaaaccctattaaaagagcagaaaatttgtttaagttccttgtatattctggatattagacctttatcagatgggtagattgcaaaaatgttctcccattccgtaggttgcttgttcactctgatgatagtttcttttgctgtgcagaagctcttcagtttaattagatcccatttgtcaattttggcttttgttgtaattgcttttggtgttttagtcaggaagtctttgccccaaaggattgtagatcattctactataaagacacatgcacgcgtatgtttattgcagcactgtttgagatagcaaagacttggaaccaacccaaatgcccatcaatgatagactggataaagaaaatgtggcacatatacaccatggaatactatgcagccatgaaaaagaatgaattcatgtcctttgcagggacatggatgaagctggaagccatcatgctcagcaaactaacacaggaacagaaaatcaaacaccacatattctcactcataagtagaagttgaacaatgagagcacagggaggggaacattacataccagggcctgtcagggggtggggggcaaggtgagggagagcattaagataaatacctaatgggtgttatccagacacacatacatttagatattcaaagcatgtgctcttggagaacaggaagtttttttcacatgatactgagtgatgaggtgaagattaactgaaagtagcattcgttgtagaatatttaagtacgttgtgttttacaatcggtattgatttcagcatcatctgtatgaatataacttttcaattttaagtttggggaaaaatgcttctattctttcacagtttgattgctttatccatgagtggtttcctactgaggaaaacagaaagccttaatttactcagcaaatagtcactggatgccccacctagtacgagggatcctattcaccacactctcttaaggaagcatctatattgctttaagatctacttaatttctgatttaaaaaaaaaactcaacttctgaattagttttttatatgtgtatatatatttgctatgattgttcaactcttccaccaatttggagaaaaaaacaaccttggaggaaagaacatttaccttctcactctacagttgaacagtgtctagaattatattatgcatacagaaagtgctctgtaagagtctgcatttctaagaaaccagttcaacagctgatgcctttgactgttcctgtcccctccttttcttggctagagataggagtgactggtaacaattccagcttcattaggcgatactcacctctggcccagcctgtcatctctccaacggaacacatcatccctaatcaactcaaaccaattactgtgtgactttgggtaattaacctccctgtgtctcagtctcaacttctgtaaagtgcaggacttgcaaaatattgctgctaaggtccttccatacctaaaacacctttggtctaaaaatacatcaccttgggaagcaagcttccttccttgcaagtcaagatttgaatgcaacctggggccctgaggagggcccctcctggttctacccctactgtgctggctacaccttctcatctgactgatgcatcctcattctgggcctgatcactaagtgtgtgacccagggctcaatcctcctgcctcttctttttcattctgcactcgagtcttggatgagttcaattccatggctttagatgttgtctctataaaacaatgatttccatgtatatctctagccccaccctctcccttgaactccagatgtgtatctaactgtccattcaacatctcctcttggatgttctttgggcatctaaaacttaagttgaaaactgagctcttgatatccacttccatatttactgcaaaaacttgatactcttcagtatcaagatctcttctgaagcctgcagccccagagcatccccacgatctgactgtttcacatcctccaccgccaccacctttggatgcaagccactatcagtcctcacatgatctacggaggatctaacacccccctgactctctcgtgcttcttctctttcttccccagagcctatgacccacctagcagccttttagaaccaagcagatcatgtaacttacaagattaaaatattctaaggataaacacttgaggtggtagatgccccaatcactctgatttgatcattatccactgtatgcctgtatcaaaacatcacatgtacccgataattatataaaactagtatatgcccatactaattaaaaatttaaaaattcaaaaaacgattccaaggatttctgatcacaattaaaatctaggtgtttatgtatggcctataaggcctaaagggatgtgacccctggaaaactctcaagtctctgtcactcattcactgacctctttgtcactgttcacaacactctgtcctcgctgccagccatgtccctccctcaaatgctccatgattctctctcactgcatccaggtccctgctggagaaccgtctctttgttccaagctatataaaatagtgatatggtttggctttgtgtccccacccaaatctcatcttatagctcccataattcccatgatgtgggagggaccacgtgggagatgattgaatcatggagggggtgggtcttttcccatgctgttctcatgatagcgaatgggtctcacgaactctgatagttttgaaaatgggagtttccctgcacaagctctctttgcctgctgccatccatgtaagatgtgacttgctcctcccttaccttctgccttgattgtgaggcctccccagccacatggaactgtaagtcaaataagtcaaaaaagtcaaaaaggtttcttttgtaaattgcccggtctcagatatgtctttatcaacagtgtgaaaacggactaatacagatagtacatgctcctgtgttttccctattcttctgtcttgccttattttttacagcacatattgttcctggcataattatatatatttaagtatgtatttcttatctccttcacttactggtggtaagccttcataagagcagatgtgctttgtttacaacatagataccaagtatctacaacagtgccagacacatagtaggtatctaacaaatatgtattagatcatgactcatagccttgattcatgagttccagctgctgggcaaatctaacctgtgctgctgaggtgatcccatggaagagctcagttctgaaggatttcctaacatcacacatgataaggatagtaacaaaacgtgcccactatgttgcagataatgagctgagcttttttttttttttttctggcttttttgaagatgttttcttttacatgaactactatgaaagaaaaaaattagatagcaaatagaaatgtttaatatgttttgatgtttacatatgatacactatttatttatttattcattcattctgtcacccaggctggagtgcagtggcacaaccacggctcaccttaaaagcctggtatgcttcctaattctcttgattagttagcattgacaagtcaacttgaaatggctagagagagtctaccaggtcatcatcagtctattcttcctcctcatgtctggatttctttgagatatcatcattatcttcacagcctttcctcttcttcataattacattaagtgcaagctcagcagaatgacattgctccaacttcggtttcagaacagcagcttcttcagatctgggtggtacatacttttttactcaatttctcatgcttttcattatatctcgtaacagtgacaagcaagttctgttctctctcaacatcagactgtccaataaataactttccgtagtaattccagtcctgaaggcactggataaaatggcaggcagggcaatttgggaaggtgtgtataaacagtaagcagccatcaatgtgattctattaagaagttcatcatctgttttcctcaaaatgtctggattctccagcattgcatagtaagtctttaaatcagtgaggaagcactccagtggtctataggggttgtggacagtcagatggaaatttacgttgctgtataaaaggtagttcgtattccaaactctgttcaagtgtctcctcctgtacgagagaactctcccgaaggtttccaacaaactggggactagatacattcagtttatctactttgtaggccaaaaatgcacatgtgagcattattatccaggagtgatagttattacttatttaccttacttaatcctcaagcgaaactacctcggattctccttttgagatgagaaaccagaaggatgggcttcacagttaagaagtaagtgacgaatcacagactttgtgctcctaagtttctcgctttaacacaaagcacaaactcaaatgccaatagggccaagccatattgaaaatgagggctgcagattgggaatcatccagtggcctttcttgctttttcttgtttcttgtttttgtttttgtttagagatgggtcttgctatgtttcccgggctggactggaactcctgagcccaagcgatcctctcgcttctgcctcccgagtagctgggactacaggcatgggccaccactgtactaggcttcttcttgttttcttttgtcaactcacctttttattttttattttttgagatggagtctcactatgtcgcccaggctggagtgccctggcacaatcttggctcacagcaacctgcgcctcgtgagttcaagcgattctcctgcctcagcctccccagtagctgtgattacaggcacccaccaccacacccagcacatgccaccgcactctatttttagtaaagttggggtttcaccatgttggccaggctggtctcgaactcctgacctcaggttattcgcctgtctctgagcccagcctgtcaactcacttttaatagaaatcagaatgcagataggtatttctctgtcattaaagaaaaaatggtagtcactaattcatgatgatgcttcaaagcaggagtgcaacagggagccaggaggaccgtggcaagttggagtgtatgggcaaatcctgaaggggaagatcccatgtgtccctagccagtcactgccatgaagtaagactggcccagagcagccaaatcttccactacctcaaaagaaactggaaattcagatttttctatgaaatctcccaagattttcaatgttaggtaaacacagacaagcactagagaccatacaaggcttgtctgcaggccaggacacagaggcatgtcagcccacagacaccgtggttgtaaatcctggccagagtcctgtgctgggtattacagtgaagggatgagacgtggagaagggaagagggagagaaggtgacctgagagacagctcggagatacatcctaaggaaggaaggaaagacaaacacaagacagcgccattgccctatgagatcatcaccccacaagctctcagaggagggagaattactcccatctggggcagccaacgcaggaatcatagagcaagcgggatctgagcagaccccgaacattcgaggccaactgcttgaatgagtagaaaggtacctccgcgtttcaagattcagacgaaacaatgaacgtttaatgttctgaaatgcataagacactccatgcatttaaagaagtatttcctatttacaaactagaaccggcatcatatatgaagtttatattgtctatttcttgcacataagggtttgttaccatcttattaagacaacgtgtatttttgactcgagtgctaaagctatacaagttctatttttaaatcaaatggtcgtatgtttatattttatacctgggagtgcaagtcactgtatttgtcttattccatcctttcttcctttgcatttatttatagtttctttgctgaaaaaaaaatcagttgattcttaggttgttagttccataaaagcagttttgaaaattcaatgtgcccatatattttaaagtgactttcaataattagggactgattagaaatgtctagtagtgacagtttctctttggctttcggtaacctttctgtcctcagtctggcagctgaaggtttttggtttgtggcttttaaagtggtgttaagggacatatttctgcctgagaacagagctgtccacccacacatagcccaactacactgtgctcatgcaatcataaattaaacaataatttaattttaaaatatttaaagataatatttacattccatattgggtgatacattttaaagacagcaattttctgatgaatgtttttaattttaagcactctaatataaggaataataaaaatgacattttagactattctgaatttagaagcataaatagagaaattcggggcctagttttcaagaatagatgctaagagaataaacaaaattaaacctgtcattatgtaaaatttttattcgccctgtgcatgatattttaatatgcattttatggagtttgtaggaagtttaatttttcgtttggagtaaaagatagtgttacacggtataggtgataaatcaggttatcatagttatgtgtgtgacccttaaaaggtgaacacactaaatatacctcaaagacagagccattaaccttaaagtggattgcagatttggcctgtgggaaaaagaagtgcaagcgaggtgtagaggtttttattagtactcccactatttggttataggtattagaatatttgaacataacatttataggctagctccatagagtctcctggaaatctttatttcactggtttttcaacttgacttctgcctttcctttctgaattcatttcttactgtcatactactggcacctagaagaatttctctcgactattttaacaagccttcagctgactgttttgcctacacaccttatcaattcccacttgtgtatcttcactcctgtctttaagacaataaacaatggagagagtcagataggagtttaaattccagttctgctatcatttagccctgtgtctttgtgcaaattatttaatctctgtgatttcgaatatctttattcataaaataaacaccttctgtggtattgtggggactaaatcaggtgggtctattccccacatcttgaccacagaatgtttgttgccacagacaaagccccatactgaaatggctgattagagacacagtccctactcagctcatctagctcaccttgggcaaatcatcagaattccctaagtccggccgcctcacccaacaactcagggggcagacgtggtgactcagcccggctgctgttcttccagatccacatgctcattgcctcagcacagctggggagaatttccccacccacatcatactgtatttgttcatgtatcatctagtaatgattttttagattttaaaaagcaatatgatgcaatgaacaagagctgccttccaatccttttatgtctacacgctaggtgttcgagggcaaaggaaacagcaggtacttgataaaagctgattacataaatactctccccaatacagtgtatagcattaacctacgcaatactaaatcactacaagcagcacatcttccagacttaattttctttgagtctatgactgaatgttgatattctttgtatgacaaaacaatcttttatgtcaatatatccactgaaattttgtagaattttttacatttattttcaggttatatattagttttttaaacaaatgtatacaaaagaatatcaaaaatctcattgttatactattcatgttactcttgctacttttataaagaaaataaaacgtatgcaaatgtagacacatgtgtaacataaagtaatgacaccttcttgtcctcagttattctattctaagttggtcattttatcagttttatgttttagtccagaatatatccatgcatatatatagtagcctatgtgcacacacattcttttcttatttataccttataacatgctaaataagtgctctatacctcactttttactctttataaaatatatatacaggccgggtgcagtggctcatgcctgtaatcccagcactttgagaggctgaggaggacagatcacgaggtcaggagttcaagaccagcctggccaatatggtgaaaccccgcctctactaaaaatacacctgtagtcccagctacttgggaggctgaggcaggagaatcacttgaacctgggaggtggaggttgcaatgagccaagattgtgccactgcactccagcctgagcgatagagcaagactccatctcaaaaaaaaaaaaagtgtatacatatatatatatataatgtacatatgtatttgtatatatatatatatatataaatacacgtgtgtgtgtgtatgtgtgtgtgtgtgtgtgtgtgtgtattttagagaggagtctcactatgttgtccaggctagtctggaacttctaggctcaggtaatccacctgcctcagccccccaaagtgctgagattccaagtgtgagccactgtgcctggcctcactttttacccttaatactactccttagaaacatttccttataagctatgcaaaaccacacgacttttaaaaagtgactccataatatcccatgatatggctatctcatcatttccattctagctcccttttcatagtttcattagctttttccagttgtttgctattatcaatgttgctgcaatgtgcatcctttaactttacatcttggcaaacttatttgagtacatcctaactctgtgattaggatcaaaaggtatgtaaatttatttgtagcttattttatttaaaaacgttataatcatttttcatgtttaaccctctcaaaatcactgcccattttacagatgagaaaaagcgggtaatttggtcagaacacatgatcggttaatgtgtagagacaaaattagcgctgaaacctgcctgcattcttcatttcttttctatcacttcaagctgcatttccaatgaactccaaagaaaaggtcatctggaaaattgggcgtcttcaataaatggattaaggtggtggttgacaaacctttgaagaactgcatggaaaaagatgcaaagaaagacatgctgtgttgtttttttcccccacagactgacctctttggagttacaataaagccaagcttttttcttccttgtttaccaggttctatgagagagaataaagagaaagatattcgtgttgatgaaaatgatgacagataaaatgtgtttgaaggctataaaagctccttacatctggagcagctggcagcctgggattggactctaaggggagctcatagatatctaatttgagcaacggttaaaagtaaacttgggaacagctgagtcagtgcagttatctctggctctgggaagtttttgtgatgtttagaggctggcacataaaaatccacatgacacatatttgctgagtctaatatccttatgaaaatgaacagggatgatttacaggaatatattagacacagatgttcttatataaaccaggatataacatgatatagaaggtaatgagccattaaaatgggcagaaaatacttgctaatgttttaataattatgtacattaaaatacacaaataacatacaaatatcagtggcttagaaatcaattagattagataaattgttagtcattcagcaaataattatggcctactacaaataaggcatcttgctacaactcacaagacacagaatctttgtacctcaagtgtattttaggatcatacgccggggatactgtctccaaaatgaagaaacctagtactttaataaaagcagagatggggtgggccagggccacaaagctatttaagctattgtgattttaagcactggactgatcttcagctcaaattccacattggagatttcagcaatgaggaaggggaaaaggcaagggaaagttgacaacttagttggataaacttacatgacaggattctgataggatgggtctcaaagcttcattaggaattttcattccaagctctgatacatgctgccctcatgatgcttaaaatctagagaatatgatgagcatacacagacttctctaatatgaaatggtatgtgatacatgtgatatgagtcaataaaataagtacagctagaacagtagcagcggggatgaaaagaacaaaatgactgaagaaccgttgctcaggaagaagcaacatgagagtttttaagattggtgaaggtggtctggtgtggtggctcatgcttgtaatcccaacactttgagaggccgagatgagatgagtggatcacttgaggtcaggagttcaagaccagcctggccaacatagtgaaaccctgtctctactaaaaatacaaattagcctgtaatcctggctactctggaggctgaggaagaagaatcacttgagcccaggaggtggaggttgcaatgatctgagatcatgccactgcactccagcctgggccacaaagcaagactatctcaaaaaaaaaaaaaaaaaagattgttgcaggggatgaaagaaaagtaagaggtgcagctcaggattttgaatctctacttgagagataaggagaaaggtggtactattggggaggatgcaaggaaacgtgagtttgaagtagagttacagcatgctgaagtcaatgagctggcagggcttctgtgcagaaatatccagcagacctttggaaatgcataagtgaaggctctaaagcagtaacagcacaagggtcacatgtttgattttaatctgcttagaaaggatacttgaatacatgggtgagggtaggaatatatgcaaaataacacggagaggaaaagaaaatagaccgggatgagctgtccatctcactgaagcaggaaccaatgcgggaatgaaatagtgataaggttaatgagccatgtgcactaacgcagaagccgagacaggaaggagatctgagaagaactgaatgatttgagatataaaatataccttgcaaacaaaggaagtcaaggactgagaaagtgccatttaatttggtcctgttggaagtaaatgctcagtgccgccaagtgaaaatagcactcaggcaaaaattttctcagcaaggcaatttacttctatagaaggttgcatcttgcggatggagcaatggcgagagcacaccggacaagggaggggaagggggtcttattcctaacccagtagtccctactgctgtgtcttttccctgttggctagggttagaccgcacagtctaagctaattccaaatggctattttaaagagagcaagggtacgagtcagagtggtggggtaagtagttttggcgggagggacagttacagaacaggtgaccagggatgcctaaggacagaacaggcgatagaggctaggagggggttgtttactgaaactaggggcaaggagggtaaggaacgaggaagtcaaactttaaaatggagaacaaagaacagggaagctgaacatactgacatattggttctttgaggaggaactcagaactcattgtacttaacaatttgtctctctcttggattttaaaggaagttaacaggctaaactttgaagaggaatttactgtatcctacagtccataggatgtgattggtgctattcacacttgagcttagccaggaggctgagaagcaatgtgattggtgatgttcaatggagaagatggtagtagagcaaaagccaaatcgcatcttagccttgtctattgcgatcacctctcaactgcactttctacttctaacctttcctttcttcaaccatccttctttctacccaaagttatctttctaaaagccaaatttagtgatatcactcctttggttaaaatgttttgatggctcccattgcctgaagacttcaaagttctcccaattgaggtgacgctcaactgacaccttttgctacaatcaactctatattatttgcccttctttagcaggtcctaatttttaataccttttgcctttgctaatactggcccttcaaaataaaatacctcctaatctctaccaatggcctcacaacctatctcaggtatctcctcctgtgtgaggacacccctaatcctgcaggcaaaatgaatgcctcctttcaatgcttccatagaacttttcaggggttgctattgggttattatatcatgttaactaaataatgatttgtttatatatcgtgtctctcctaatgtggtacaaaacatatgacagtattatattcattcttatagccccggtacccagcattgtccacatatgttgtctttcactgcttttgaatgaatgaatgcataaaatggctgctaaaatataagatgtttgggaatgtagagagctgagcatgtttgaaggcagaacagaaggaataagtcaagggaaaagatggctaacgctgagagagggaaaggaggagataattaatgagctacatcccgaagaagacaggatgaatgatataaataacaaagatggtgaagtgagacttgggaagaaaaagagacaaattgtcaactgaaccaggagaccgtggacaggagaccataagtgaattgacagtcattgagccccttttatgcaccaggtactgggataggttctttatgtatctttgctcattatgtagcattacaagccttgtgacctgtccatttacagatgaccaggccaaattgaagggttttagaatttggttttagtcacggaagtcaagtttgagccctgggccgttttttcccagtctcctgctttttccatgaaataaaaattgtcagtggttggaggccacactaggagatcaggaggacaaggcattttcaacggttagaaggcaaaattaaaatgacttagagtgcgtctgggctgggttactagataagtgaagccagaaggctgcttacattcacataggcatattttatcctgctcctttaccagcttgggctgagaaagaaaaggctactgttatgttttagagtttgcaataatcttctgaatgtttccagcacattcccttggattcagaaagactgtattagatactttatttcacaaatacccatgaagcacatgctattatgtgctcagtatggggaatttcttgtgagatatcaaataagaatcagacatagtccttaaggaaaagatattttaatggagttttgatagaaagaaaatcactattccatgagaagaatattatacatgctgtaaaagtgattcaaagaaaaagatgagacaataattgatctgaatctaatgatatatttggaagagattatgttaaacgaagaaggcaggataggcattccatcagaaagaaaggaatgcaagaaaggagagaggagaagcagagaggggaggggaggacggaaggggaggggaaggggggaggggaggagagaaaagaggaggggagaggagaggagaggagaacacagaagattgactgtgaggaacaggaaggtgattcagggagccagaggtagtccagtgtgtatcactggaaaaggctaagattaaacaccacgagtaacgtgtacaattttgagttacaggctaagatattattaagatccgtacccagcaggcattagggagccactgaggcttgaagaaaactccaatacaggcagtgtgattttacagatttgggtcaagtttattattcaagtaaaatccttctgtggcttctcattgctgttagaataaagtctaaaatccgtatcaggccccttcaagtcatacatcacctggtttcaacctaactcgatgctgctcccagccctcccaccccaggggtttaacatattctgctccccctaaaagactctctccccttcttcccttgggaaatgccccactttctctcaaatctcaacatacacatcactttctcaggaagaatttaccctctgatattctaggctagattagtgcctctagttataacttcaaggcaaactgtcctttctaacatcgaattagaattataattctataggtatttggatcattacttgtttaatgcccatctgcaaaattaaactgtaaattccatgaaagcaggaactacgtaaaaccggctaataaacattatctccatgtctaacacagaagagtaatacataaatcagctcaagcctatgaatgattgaagatgacttatttgatgtaaggccctgagatgaaaagataaggaagctgttgagacatctagtaaaagggttattgaaagtatgacacaaatagaaatggagaagtgtgtttgagatgtattttaagagtagaagcaggccaggcatggtggctcacacctgtaatctcagcactttgggaggctgagggaggccgatcacgaggtcaggagatcgagaccaccctggccaacatggtgaaaccccgtctctactaaaattacaaaaattagctgggcatggtggcgcgtgctcgtaatcccagctacttggaaggctgagacaggagaatcgtttgaacctgggaggcagaggttgcagtggccgggatcgcgccactgcaatccagcctggtgacagcaagactccgtctaaaaacaaacaaacaaaaaaaaggtagaagcagcaggacttggaatttattgaatggattatgtctaagtaacttgagaggcctgataaaaaaaaatttaacatgttccattggttttctatctttcctgattttaaagaaatcctttctcaggtctgttatagtatctcccaatagccattccttttatcctatgcattctttatagaacagtctaaaaatatttattgagcacctactatgtgcctggcgctcttatgggtgcttgaacacatcagcaaacaaagcaagcaaaggtcccaacattcgtggagcttacatttttggcagaaaggtacagaacctaaagggtaaactgcagatataagcatattatagtatacattcaaaggcggtaggtataggaaaaagaaaagtagaacagtgtaaaagggatcgatagaaacagcccagtagcactaccccagttatctatagcacataacatgtattaattttaaaagcatctctcttttttttgtttgttttacttctaatgaaacccagaaacgttccaagtaggcattcagtgaaatgtaattgctctttttctcatctgtttcttggagataaaatcctcaagggcagagaagaagcaaggtatcacagaagcaggaagaaagctcctggttggagctgggagcaagagttctgcaccagcactctacacatcagttcaggagctctcagctcctctcccaactcagcgctcagcatctcagcatagttcctcagacttcttttttttttttcttttttttttttttttgagacagggtcttgctctgtggcccaggctggaatgcagtggcatgatctcagttcactgaaacctccgcctcccaggttcaagtgattctcatgcctcaacctcccgagaggccgggactgcaggtgcccaccatgacacctggctaatttttgtgtttttagtagagacagggtttcaccatgttggtcaggctggtctcaaactcctgacctcaaatgatccacccacttcagcctcccaaggtgctgggattacaggcatgagccaccgtgcccggcctgttcctcaggtttctaaccaactccttaattttgttattatattttcttaggctgaaaatattttcttaagctacttttgtgcttctcacttttcatcagtttcttctctctaaaagtctttcatggacttactaacctacaggaaagcactggacaatgcattttatttgtgggtgaaagttattttaaataactagttagctacatttaatttttcattcatgaattataatttttcatggctttctgaatagtattaataaaatttgcatattcattctaacagtaaataacataataaaagataataaatatttaatagcttttccttaacttttagaaaacagttggaacaattcaacttgttaagacactgtttacttagaaactttctcaaagcagaaggtaaatatattttttaattgctcattacctaaacagtaagaaaagaataaattaacttcttcattatcttagtctacaggaagactattttttaaacgaaagaacagtttgttaaatagattccaattatttatataagttaaagcttaactacaataagtttaaaagtcatatattcaattattattttcatttattcccaataatggagttattttgttagattaaatgtcctgattattttggctttgggcagacatgactttaatgtgtttataggttttcaattaatacatcagtaatttccataaaattctagctgcttgacttctcctttaaaaaaaaagaagtttaatactcttcatttcttcctatctgtctgcctcattcatgtatatatttatattcccctctgtccctgaaggtatataaattgacaatctcaattcattgatcaaagaaaaagtatcagaaatggaccctattcctcaaaaggcttgcaacgtagtaagagtgacaaaaaataaataataaattcaaaaaataattaaatacaaaaaggcaactttaataggatgttaactttgtttcttctgcatatattgaattttcagatgagatactatccccactccccaaaataaaacaaaacctgggagcaatgccataggtgccaaaccacctcaaaggtatgaaacagacattgaagactgacccagtgcgagaggataagaattccttcgggaagttgttggggagttgtggtaccatgataccaggcaggggagtgtttccttgtaaattccttgtaaacttaattcagttgaggaggacttaagggtagccacccaaaatgtttagtgtgtgtctttggcatctcaggaacccagagactgatgtctgacttttccagcaccaaagtggtggccaactggaacagaaagagctgagctgggagtgagctatacaaccatcatcaggttcctccccagcagaagcaaagcaggtgtgtgtgtgtgtgtgtgtgtgtgtgtctggtgtattgggaagaaaatattagaaaaagattggaggttttcgtttgaccctgaattcagctttttaaagccaaacctgaggggccattaactttttacctgagagtaatcttgaaaagtatgagattacttgatatttttaccccaagttctggaactacagtttgttgaaagtaggttgaaaggtggcaggagaaggaaatgatgacgttgtttccttcgggtgcccttcctagtcctgttcatcagatgaagtgacacaatcgatcggcatgagggaccaccaaggttgttcactatgaaatacagaaaaatttttttttaatttttattttattattattatactttagttttagggtacatgtgcacaatgtgaaggttagttacatatgtatacatgtgccatgctggtgtgctgcacccattaactcgtcatttagcattaggtatatctcctaatgctatccctcccccctccccccaccccacaacaatccccggagtgtgatgttccccttcctgtgtccatgtgttctcattgttcagttcccacctatgagtgagaatatgcagtgtttggttttttgttcttgcgatagtttactgagaatgatgatttccaatttcctccatgtccctacaaaggacatgaactcatccttttttatggctgcatagtattccatggtgtatatgtgccacattttcttaatccagtctatcattgttggacatttgggtttgttccaagtctttcctattgtgaatagtgccgcaataaacatacgtgtgcatatgtctttatagcagcatgatttatagtcctttgggtatatacccagtaatgggttggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgagtttttaatgattgccattctaactggtgtgagatggtatctcattgtggttttgatttgcatttctctgatggcaagtgatggtgagcattttttcatgtgttttttggctgcataaatgtcttctcttgagaagtgtctgttcatatccttcgcccacttttaatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttacggttttaggtctaacgtttaagtctttaatccgtcttgaattgatttttgtataaggtgtaaggaagggatccaggttcagctttctccatatggctagccagttttcccagcaccatttattaaatagggaatcctttccccattgcttatttttctcaggtttgtcaaagatcagatagttgtagatatttggcgttatttctgagggctctgttctcttccattcatctatgtctctgttttggtaccagtaccatgctgttttggttactgtaggcttgtagtagagtttgaagtcaggtagcgtgatgcctccagctttgttcttttggcttaggattgacttggcagtgcggcctcttttttggttccatatgaactttaaaatagttttttccaattctgtgaagaaagtcattggtagcttgatggggatggcattgaatctataaattcccttgggcagtatggccatttttacgatatcgattcttcctacccatgagcatggaatgtccttccatttgtttgtatcctctgtaatttcattgagcagtggtttgtagttctccttgaagagctccttcacgtcccttgtaagttggattcctaggtattttattctctttgaagcaattgtgaatgggagttccctcatgatttggctctctgtttgtctgttattggtgtataagaatgcttgtgatttttgtagattgattttgtatcctgagactttgctgaagttgcttatcagcttaaggagattttgggctgagacaatggggttttctagatatacaatcatgtcatcttcaaacagggacaatttgactttctcttttcctaattgaataccctttatttccttctcctgactaattgccctggccagaacttccaaaactatgttgaataggagtggtgagagagggcatccctgtcttgtgccagttttcaaagggaatgcttccagtttttgcccattcagtatgatattggctgtgggtttgtcatagatagctcttattattttgagaaacgtcccatcaatacctaatttattgagagtttttagcatgaaagttgttgaattttgtcaaaggccttttctgcatctattgagataatcgtgtgatttttgtctttggttctgtttatatgctggattacatttattgatttgcatatattgaaccagccttgcatcccagggatgaagcccacttgatcatggtggataagctttttgatgtgctgctggattcagtttgccagtattttattgaggatttttgaatcaatgttcatcaaatatattggtctaaaattctcttttttggttgtgtctctgcctggctttggtatcaggatgatgctggcctcacaaaatgagttagggaggattccctctttttctattgattggaatagtttcagaaggaatggtaccaattcctccttgtacctctggtagaattccgctgtgaatccatctggtcctggactctttttggttgctaagctattgattattgccacaatttcagagcctgttattggtctattcagaaattcaacttcttcctggtttagtcttgggagggtgtatgtgttgaggaatttatccatttcttctagattttctagtttatttgcgtagaggtgtttgtagtattctctgatggtagtttgtatttctgtgggatcggtggtgatatcccctttatcattttttattgtatctgtttgattcttctctcttttcttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgaatgtgtcccagagattctggtatgttgtgtctttgttctcattggtttcaaagaacatctttatatctgccttcatttcgttatgtacccagtagtcattcaggagcaggttgttcagtttccatgtagttgagcggctttgagtgagtttcttaatcctgagttctagtttgattgcactgtggtctgagagacagtttgttataatttctgttcttttacatttgctgaggagagctttatttccaagtatgtggtcgattttggaataggtgtggtgcggtgctgaaaaaaatatatattctgttgatttggggtggagagttctgtagatgtctattaggtccgcttggtgcaattattaaaccaaataaaagagatgagtgtgcattgcagagaacaacacaattttcatgaaaacaaaatgaaaaaaggttggaaaagagttggggaccagttacagaaaactttagagtttggacatcataaagtctggggacacattaaactgtggccctgttgcctaaaaagttcagtggatcattctgcaaaactaattaaaatctgaaaattgactttgaacatagagaataaaaatacactatggcttcaaatgctctgcattttctttaagaaatttttattaagtggcttatcaaagccgattattagcccccactattaaatataccaagtaaatcaagatgtaaacaaacatattaaactaccatttcattaagggcacaatttgaaagttaattggataagaagtgaataaagacaggaaaggcaacagtgtgagtgagtggttcaaaagaaatgatagcctggaaacatcatttgaagagcaatacagcgaggaagtagatcaaaagataccgcttcccaggagtttcttgtgtcattttaaataatttttaatatatggaggtaagcatggatctaggaacagaattttgaacttaaaatcagtgggtaaaaactgttgttgtacctagttgtacatcaaactcctgagtatattaactgtacattcattatatgagtatactaatttatgctaattgttgggaaagacagtcccccctcagtctcttgggctcttacatgtcttactgggtttatcaagaatgcaaagcactgactgctgttttctggggctatttctcagggtcatgtttgcagagcaacctagagagatgatgtcaagtctctctctgggacaaagagcttgttttcttactgcttgctttaaaaccaatggattccccaaattcagtgttacctggctacaggcaaacccactgtgcatatagcatccatctcgtccctccacatcactcccatgagatctgaagaagggacaaaggaaacaacacaaacatgatgatgctcatgctgctgatggacctttgagtgttgaagtcctttgtttctgacccaggagtcttgtgttttgtgccagttatccatgaagcattaattagctagtttactagcttgtatgcagggtgaaatctcagacctgagaatcatcattgatatgtgtagtctttaccatgcacatgacttcccctggttgggtatatcactcaagaatattcaaaatactgtatttggaatattatgttatgctactagtctaatcattccttacttgttggagaactgttcattgttaatgcctcaaggcaaattagtaacatgtatatacctgaataattcagaatccttttcttactttttttacatattcatcttttaaataagcttcatcaacaatttctcatcatttgaacctcccaactcttacccttttcaccagtttgtattggctctctttctcctccagagacctgaacacacaaaacacacaacttgaattaaaaatagagagctggtctgttggggttctcttctctactcatactgtgacattgattgcaacttgaacatgtcaaggagttacctcaaccttataacaatatataaaataataaatagatgtggcaacataaaaatattgctataatcttataaacggcaggttgaagtaagataattatgaggatgaatagccttattggtgtcaaatacaatagtattttcggtaagtgtgtgacagagcgtcttctattcctttgcaaccaatagtgaagactggtggaaatatgaactttttctcagattcataaaggcataagaagagatagtgacataattataattatattaagaagcatggttgattggttgtcagcacacttacatttaacagtcttgggtgtttttacatgataatggcataatgacagtaatgaacttagaagttattcttagcaaagtatcatagcagagtgcaatcgatttctgcagaagctataaatgcaatctccaaccttataggttattgtaaatgcaaagcacaaattctcattcataactacttaattaaagaacattattggtttacctgtaattgctttaatttatcacagtgttacaatttataagtaatgtgtgttattcttcagtagttttattgtaattacacataatttacaattcacattaccggatttctaattagcccctaaatattcttggttataaaaatgaaaatactattttaaggagaacaggataattaacaatgtattaaatctattggctgtcaagcatttaacaaacaataaagtcaactaattcaggcaatttagatgatgggttataaaatgttataaagttatggagtgcaactttgccgccattaataacactgtttcaaattaatcttggtagaactctggtcaacattttatttggcaaagcaacacatccagcatctccttttatgtttgggtggatggcactggagagggactggtgtagacatcaatcagaatattcctaaacaagctttcctgatgttacagtttccaagttacttgattcagaaggtggaatagtgaaaatttcaatctattgaatctattgtgattctagagattgggaaagataatgtggttagcttagtaaaatcactattttgaattttcttcaaagtttgtaaacagccttgttttggcatgatgtcgcagtaggccaaagtcacatgacctcaccctttcacttgaagataactaaagaaagacacatggtgagccataaatgttctatagaatatgcagccacctatacagtgtgttttgaaaagtctttaaaattcagtatcttttaaataaacctgaaatttctattattagaaacaatccttgcggttaggcattgatccagaaagcttccataaatgcaactatagtatgtacagtgaatgaaatatgaatggtctttatcactgaattcacgagaattcatttttagatgaaatatatcaggcaagaggtagaagggacagagaaaatactgtcagaaaataaagaagagaagaaagttctgttgaggcaagaaacccagctaaagtaacataaaactatgtgtggtagggtggggatatgtccagcaacccaaagaaccttgtgacatttctgtataccaggacagaatagatcattgaagaaaattgagactggcatccttgcttggtaagtttgtctaagaccaaccataaaatctccctgctaaggttttttgggttttggggttttgttgttgttgttgttttaaatcctggtccttgaagctgttgcatttccctacctttaatgaaaatggagctttctataattcagaataaaaataattgcttataactttttaaatggcatcaaaagatatggtcctggtgtggctggcaaaatggccaaataggaacagctccggtctgcagctcccaggaagatcaatacagaaggcagtgatttctgcatttccaactgaggtacccagctcatctcattgggactggttagacagtgggtgcagaccacggaaggcaagcagaagcagggtggggcatcacctcacccaggaggtgcaaggggtctgggaactccctcccctagccaagggaagccgtgagggaccgtgctgtgaggaacggtgcactccagcccagaaactacacttttcccatggtcttcgcaacccacagaccaggagattcccttgggtgcctatgccaccagagccctgggtttcaatcacaaaaccaggcagctgtttgggcagacaccaagctagctgcaggagtttttttcataccccagtggcacctggaatgcaagcgagacggaaccgttcacttccccagaaaagggaccgagtccagggagccaagtggtctaccatccatggaacccagcggatcccaccctcacggaacccagcaagccaagatccactggcttgaaattctcaatgccagcacagcagtctgaaatcgacctgggaagctcaagcttggtagagggagcggcgtttgccattactggggcctgagtaggtgttttgcccctcacagtgtaaataaagccgccagggagttcaaactgggcggagcccaccgcagctcagcaaagccactgtggccagactgcctctctagattcctgctctctgggcagggcatctctgaaagaaaggcagcagccccagtcaggggcttatagataaaacccccatctccctgggacagagcacctgggggaaggggtagctgtgggcgcagcttcaacagacttaaacattcctgcctgcctgctccgaagagagcagcagctctctcagcacagtgctccagctctgctaagggacagactgactcctcaagtgggtccctgacccccatgcctcataactgggagacacctcccagcacgggtcgacagacacctcatacaggagagctccagctggcatctggcaggtgtccctctgagacgaagcttccagaggaagaaacagacagaaatcttctttgctgctctgcagcctcgtctggtgatacccaggcaaacaaggtctggagtggacctccagcaaactccagcagacctgcagcagagaggcctgattgttacaaggaaaactaacaaacagaaaggaatagaatcaacatcaacaaaaaggacgtccacacaaaaaccccttctgaaggtcaccaacatcaaagaccaaaagtagataaatccacgaagatgaggaaaaaccagtataaaaaggctgaaaattcaaaaaaccagaatgcctcttctcctccaaaggatcacaactcctcgccagcaagggaacaaaactgggtggagaatgagtttgatgaattaacagaagtaggcttcagaaggtgggtaataacaaactcccctgagctaaaggactatgttctaacccaatgcaaggaagctaagaaccttgaaagaagattagatgaaatgttaactagaataaccagtttagagaagaacataaatgacctgatggagctgaaaaacacagcacaagaacttcgtgaagcatacacaagtatcaatacctgaatcaatcaagcagaagaaaggatatcagaaattgaagatcaacttgatgaaataaagcaggaagacaagattggagaaaaaagaatgagtaggaaagaacaacaccaccaagaaatatgggactacgtgaaaagaccaaacctacgtttgatgggtgtgcctgaaagtgacgggaagaatggaagcaagttggaaaacactcttcgggatattatccaggagaacttccccagcctagcaagacaggccaatattcaaactcaggaaataaagagaacaccacaaagatactccccaagaagagcaaccccaagacataattttcaggttcaccaaggttgaaatgaaggaaaaaaatgttaagggcagccagcgagtaagatcgggttacccacaaaggaaagcccatcagactaacagtggatctctctgcagaaaccctacaagccaaaagagagtgggggccaatattcaactttcttaaagaaaagaatttcaacccacaatttcatatccagtgaaactaaacttcataagcgaagaagaaataaaatcctttacagacaagcaaatgctgagagattttgtcaccactaggcctaccttacaagagctcctgaaggaagcactaaatatggaacgaaaaaccggtaccagccactgtaaaaacattccaaattgtaaagaccgtcgacactatgaagaaactgcgtcaaccaactggcaaaataaccagctagcatcacaatgacaggatcaaattcacacataacaatagtaaccttaaatgtaaatgggctaaatgccccaattaaaagacacagactggcaaattgaatagagtcaagacccatcagtgtgctgtgttcaggagacccatctcacatgtaaagacacacataagctcaaaataaaggtatgaaggaatatttaccaagcaaatggaaaggcaaaaaaaaaaaaggaggagttgcaatcctagtctctggtaaaacagactttaaaccagcaaagatcagaaaagacaaagaagggcattatataatggtaaaggaatcaatgtaacaagaagagctagctatcctaaatatatatgcccccaatacaggagcgcccagattcataaagaaagtgcttagagaactacaaagagacttagactcccacacaataatggtgggacactttaacaccccactgtcaatattagacagatcaatgagacagcaaattaacaaggatattcaggacttgaactcagctcctaccaagtggacctaataaacatctacagaactctccacctcaaatcaacagaatatacattcttctcagcaccacattgcacttattctaaaattaaccacataataggaggtaaaacactcctcagcgaatgcacaagaatggaaatcataacagtctctcagaccacagtgcaatcaaattagagctcaggattaagaaacccattcaaaactgcacaactacatggaaactgaacaatctgctccagagtgactactgggtaaataacaaaattaaggcagaaataagttattcgaaacgagtgagaacaaagatacaatgtactagaatctctggaacagagctaaagcagtgtttagagggaaatttatagcactaaatgcccacaggagaaagctggaaagatctaaaatcgacaccctaacatcacaactaaaacaactagagaagcaagagcaaacaaaatcaaaagctaacaaaaacaagaaataagtaagatcagagcagaactgataaaaacacgaaaaaccattcaaaaaaccaatgaatccaggagctggttttttgaaaatattaacaaaatagatagaccactagccagactaataaaggggaaaagagagaagaatcaaacagacacaataaaaaatgataaagaggatatcaccactgatcccacagaaatacaaactaccatcagagaatactacaaacacctctaggcaaataaactagaaaatctggaagaaatggataatttcctggacacatacaccctaccaagactaaaccaggaagaagtctaatccctgaatagaccaataacaagttctgaaattgaggcagtaattagtagtctaccaaccacaaaaagcccaggaccagatggattcacagccgaattctaccagaggtacaaagaggagctggtaccactccttctgaaattgttccaaacaacagaaaaaaagagactcctccctaactcattttagaggccagcatcatcctgataccaaaacctggcagacacacaacaaaaaaagaaaacttcaggccaatatccctgatgaacattgatgcaaaatcttcaatgaaatactggcaaaccgaatccagcagcacatccaaaagcttatccaccatgatcccgtcagcttcatacctggaatgcaaggctggttcagcatacacaaatcaataaatgtaatccattacataaacagaaccaatgacaaaaaccacatgattatctcaatagatgcagaaaaggcctttgataaaattcaacacctcttcatgctaaaaactctcaataaactagctattgatggaacatatctcaaaataataagagctatttatgacaaacccacagccaatatcatactgagtgggcaaaagctggaagcattccctttgaaaaccagcacaagacaagaatgccctctctcaccactcctattcaacatagtattggaagttctggccagggcaatcaggcaagagaaagaaataaagagtattcaataggaagagagaaagtcaaattctttctgtttgcagatgacataattgtatatttggaaaaccccatcatctcagcccaaaatatcctaaagctgataagcaacttcagcaaagtctcaagatacaaaatcaatatgcaaaaatcacaagcattcctatacaccaattacagacaaacagagagccaaatagtgagtgaactcccattcacaattcctacaaagagagtaaaatacctaggaatacaacttacaagggatgtgaagcacctcttcaaggggaactacaaaccactactcaaggaaatcagagaggacacaaacaaatggaaaaacattccatgctcatggataggaagaatcaatatcatgaaaatggccatactgcccaaagtaatttatagattcaatgctattctcatcaaactaccattgactttcttcacagaattaggaaaaactactttaaatttcatatggaaccaaaaaaagagtccgtatagccaaggcaatcctaagcaaaaagaacaaagctggaggcatcatgctacctgacttcaaactatactacaagactacagtaaccaaaacagcatggtactgataccaaaacagatatatagatcaatggaacagaacagaggcctcagaaataacacaacacatctacaaccatctgatctttgacaaacctgacaaaaacaagcaatgggcaaaggattccccatttaataaatggtattgggaaaactggctagccatatgcagaaaactgaaactggaccccttccttacattttatacaaaaattaactcaagatggtttaaagacttaaacataaaacctaaaatcatcaaaaccctagaagaaaaacctaggcaataccattcaggacataggcatggacaaagacttcatgactaaaacaccaaaagcaatggcaacaaaagccaaaattgacaaatgggatctaattaaactaaagagcttctgcacagcaaaagaaactatcatcagagtgaacaggcagcctacagaatgggagaaaatttttgctatctatccatctgacaaagggctaatatccagaatctacaagaaacttaaacaattttacaagaaaaaaacaaccccatcaaaaagtggacaaagaatatgaacaacacttctcaaaagaggacatttatgtggccaacaaacatatgaaaaaaagctcatcatcactggccatcagagaaatgcaaatcaaaaccacaatgagataccatctcacgccagttagaatggtgatcattaaaaagtcaggaaacaacagatgctagagaggatgtggaaaaataggaacactttaacaccgttggtgggagtgtaaattagttcaaccattgtggaagacagtgtggcgattcctcaaggatctagaaccagaaataccatttgacccaccaatcccattactgggtgtatacccaaaggattatacatcattctactatgaagacacatgcacacatatgtttattgcagcactgttcacaatagcaaagacttggaaccaacccaaatgcccatcaatgatagactggataaagaaaatgtggcacatatacaccatggaatactgtgcagccataaaaaagaatgagatcatgtcctttccagggacatggatgaagctggaaaccatcattctcaagaaactaccacaggaacagaaaacaaaccacagcatgttttcactcataagtgggagctgaacaatgaaaacacacggacacagggaggggagcataacacactggggcctcccagggggttgggggcaaggggagggatagcattaggagaaatagctaatgtagatgacaggttgatgggtgcagcgaaccaccatggcacctgcatacctatataacaaacctgcacgttctgcacatgtatcccagaacttacagtgtaataaaaaataaaataagaaaatgtgtgactgcatgaacgtttctgaagcccagtcaaacccaaggttagaagttcttgaattgagctttagaaagagtaataaatatattttcttgcagttatcaatcagaaaataagatatgatcctaaaatcataaattttatttacagttcaaggcatatcaccatgactgccaatcatctactaaatgcatctgccttgaaatttggttgtcatgaataaactaggtccattacaccaattatactcacaaccacgaactgttaatagcacaaatctattctatgaacttttgtcgtctgatattgaaatacccacacccccatccagcaccatattatattcagagacgtaaccaaagaggcttccaaagactgtggccatttcaagcaaatcaagggttaataggtctatctagcatcttccattagtgggtgtcactgtgatgaaattaacaaagccctattctgaagactttccggaccagcttggaagcattttgtgataatggtgctcattgtaaccagatttgacctgtggtttagtatcagcaactaaaaatgcaggcatttaactacactgaatttaattctagcccaaaccaagctttttagtcagcctacgatatcacaagaaatattgtagaattgaatagttagttgcattcaatcagactcaatagattttttgtgtatttttaggtgagaaatgtgaaattaaggtgtatgggatgtctgcatttccttctcttcctggctatctttatttaatatgctcaaatcagttattaggttatcaatgtgtctctattatttctagaaacagtttgattaaattgatttttctatagtaaaattcccctttctgtgtgtgtgtgtgtgtgtgtgtgtgtgcgcgcgcttttaaatcacacttaaacatacataggaatatgatgttggacaatgcgctaattgaagtgaagagtttaatggacctgatagagggtaaggacatgccatacctcagttgattgcttctcgattaggactcacattgctatcccattcttccttttgagtatgacttgagtctgtacagtgcactacataaatgattttccatggctttttaaaaggcggtgcatattaatattttaaactgaagtaattgcttcttgctcagcaatgggtttcatttatgagtgtttatcctcagcaaatggaaagtatggttaatctaagttaaaaatgggttctttaaatagctctaattacattctgtttatatttgtatgtattagacacttaagatttaatcggtagcagttctaacaagccataatgtttattagctggttttaaattattgttatggatgggactggaatgagaaaataagtgatttgcctactatcaaacacagtaaataaaagatggaccaatgcttaaaaaaggatttttagcataacttcaaattttaatataatttatgagaaagaggtcatattaggtcaattctttttcttttttctttattttttaaactctaacaatagaaagaatgtggtgtctaatggcataagattagtggaatttttgttttcaaaaattattaagatcctagtgttcgagtactagaaaagaagggactaaattttgcattttaattcacatttattcagaaggaaaactgacatgagacataacatgttgattttttaatgaaaaaaattgttttaagttgatatgatgctagcttgtctatttaatttgcttaaactctatattttgattaaccagaaaagactttgttggattctgcttcttccctgagaaatttatccaaggacttcctctaatctttgaagaaaacttctgaattacacatggctcacacatagtgaattaggaaactcacagtcattttattgacatttaattttcaacttgttttattgtaattttcaagatatgcaaaatgaagtataattcaaaagacagtttattaataataacacctgtatctctatggaactaaaaacatttgtgattgttttcaaaaggcaatagtattcccagaaaagaagtctgtagaattattagtgtcattttataaataaggaagatgagacaaacattacaacttctttacaatgtgaagaacgtaatcgtttcatctccaccttaagctctgagctctgtccctagagctataagccaccatagcctgctaggctagttcttcttttgcagaaactctcattcctcttttgttttctatttctgttgctactttctagaggatgtccttgctaccttatgcctgaaaataaagccttgctaattcagtctagtctctctctgcccagctaccgggcatcactatggcacttgtccccttaagcacccacaatcatgccactcttcactctcaaagctgccaagaggtgacctctctctattggatacaagcccacatggctcatctctgcatgccgggcactcctggatcctgtgcctttaccaggccttccaaacttacctcccagtggtctgcaaaactctcgaatcccagccaagcctcatgtccatctcagggtttccctcctctgcaccgatgcctttccattttcttgaagcgcactctaccgacatcgggccttatggaaatctcccctattcttgaagcctcagacaaacctcatttccattatagtcgctttccagatctgggttccgaatgcatttgttttatatcattcatctgtcatgtatcctatttacctcatagcataaatcttcatatccttgttcatatccaagctatgtaactctagcttggcacataataggtactccgttcatatttgtaaatagatatttattacgggattaatgaatgttgctcagtgctgagtgctttattttgcataattaagaatcagggctggatgcagtggctcacacctgtaatcctagcactttgggaggccaaggtgggtggatcacctgaggtcaggagttcgagaccagcctgaccaatgtggtgaaaccccgtctctactaaaaatacaaaaaaaataagctgggcatggtggtgtgtgcctgtcgtcccagctactcgggaggctgagacaggagaattgcttgaacttgggaggcagaggttgcagtgagccaagactgcaccactgccctccagcctgggcgacagggtgagactccatcaaaagaaaaggaatcagatgtgagagtggctgataggtaatatttgaattaattaattagttaattactttgtagaaattgtgagtcatctctttcgcctacccttcacactctttcaataaccatttctttctattcatcatttcctgattttgtcctatgttggtgcaagatgttggtgccagccatctgggggtgaacaagacagtctttgtcaccatgagtaatagtcttagagaatagcagggaagacaaacacaaacaataatggcagtgaaatgtgttgagcgttatggctgagattgacaggaaattatggaaacgaagagcagaggacctatctggcttaatctaggggacaggaaagacctccctgaggaagtgagctttaaaccaagacccaaggaaagcccaggactaaaacaagcagaaggggagagcagcaggcccctataattaccaaggccccatgctaggctctaggcgcaaagggggaaaagaaaacaatgtttcctgccccccacgaagctttcataaataataaaacaatttgcaataagcactgtgaagaaagcaagcagtgtgttgttgtaaagaggtaacaagtggggagaatgccatctaattacatacagtggccagaatagaaatttttgaagagatgccacctaacctgtgatctgcaggataagaaggaggtggccctgggcaaagcaggtatgggagcattctaagcgaaagcaccagcgtgtgcaaagctctgacagtggagaaaacttggaccatccagagaagagaaggaaggccaaggtggctgcaaagctgtcagtagaggaggtagcctgagatgggattagcaaggtggccttcccagactatggagggcctcctaggccaagaggaagagtttgcttttgatgctaagtgcattgagaaaccattagtgggctttaaacaggagagaggcatgacccagtttatactttaaagtacaacttctgcaagaagatgattcctagcgagggaagaagaggggcagggcatctaggctgatggtagcttagccatcgtaggaagagtgacgattgaagtgggagaattctacatccatatgggaaggacattgaacaggacacatgcattggatgcaggggatgaacaaaagaggaataaagaacatgaggacagacgtgatcatgactgcacgaaggccttttgctaacttcttccttctaagcctatttctttgccccagtgctgcttcacaccctggcactactacaaaagctgagaactttcttgaattctttactataaattgagttcagaagaccttagaacaagcttggaggaaaaaatatgtgaactctgatgaatgccaatgtgactttcagtcttgaacctggctgctcagttgccccagtcatctttctcccagagtggaaagttttaaaagtctcttcaagctgcctccatccccagtgaagagaccatgaccccacttaagatgtgattttcaggtgagcctgaagagatgcctctgaattagctcctcccttttccatccaaggctctgtggcccttcctatatcaccaagccactgaggatagcagctgggccacacaacagtttcaccccttgccgattctcagtttttatcataccttggctctggttgtatgaataagtaatttcaagtagatcttaatgtggaactaagctagtttgatttcatgcttgctgctacatgtggctaagcttatattctagacattataacgttttatacctagaaggagccttagctgtcatgttatcagatgtctttattatatagatgagaaaaccaagatgtagaaagttaaagtcatttggggcacgtcataatactccagaaaatcgtaacctttagaaagctctgtattctaattctaaccacatctcttaccaactgtactaattaattcatctctataccctccttcaattttcttattttaaaacaaagacaataattcctactttgcagaatagtcaaggggatcagagataatacacaacaagcatatgatatttacaaaacactcaataaattgtcattattatatgttcacttttcgttgtccactgttaaagtgacagtatcacttagtagccgataaaggcctaaaactcgtatttccaacctaatgctcctttttatacacagcatacagcctgatagaaattttcatgagttcatggactcttcctcagtctatttaggaataacaaacaaatgcatcccccacctcgtgcccatttcgagccctttgagagtttcttgtgccctggagaattaggtacacaatttgtaactttattcagcagtgaaatgccactgtggtcgcaaaaaagctaaagcaatatttcaaccctaagaactaggtctggcacccagaataaaagactcttttaataggaagaataatctatcaattttgtgaaagggcttttggaaaaggctcaaagtcctactgcaatataaaacataaatggtacattgtcctagttttttgctggaaattgtacgttagcactaaagaacagaatttcttttgcttcagtctgcatttttagaacatgctataaagacaactctattttctaggggttaataagtaatgtaagaaaaaaaaagatggcatggattaaatgaagataataattataacagtaatcttgtgcactttttcatacttaaagtataaaagaaaatttgtttctacccatgaaagaaaaatcctctccttattattattgttctatacactttctagaattttcttatactaagatatggttataatcctagtcctgcaggaaggaaggtatgtgtctctgtgtaagaatgccgggaactcgtttctggtatcagccacttgagtgtgctctagaatcggcgtgtagcctgtctgttcaccaaaaaggtggtaggattcctaggaaaagctcctggagatttcagagtgatgtcctccatgggaaacaggccaggaagatataaataagaaccgcagagaaagagctgtggctgtgatcagcctgtcggtgtttcagtacagtcaggcgtgcctgtgaaccttggagagagggcaaaacggtaagatcggaaacttgtgccctaaaagcaaaacaaaattgttttctggacctcttccgtgatctgtttatttctccacttctttctcttagttttaaaagctccaatcatctcagctgaactaaggggaagaatgtgtctattgttggacagctatataaggggttggggtgcggggcgctcagcacatggcaggggccagggtgagtggagaataccgcttgatgagagaaccccaaggcggagaggtgtccgctgcctcctccagggtgaatcttttagggccttggttttattttagtccttttattaaagctagtgttcttcaacaaccactatttcatttcattgctttaaattatattctaaatattcatttcttttgccctggtctccataataaagactttcaaaatatcgtgacaagcaattgactgagtggagaaacactgaaagctggaggaatttaagcagaaatgcacgctttatgcacatgttctttatgttctagcttagattccttcgggatttttgctgcactattttgaagcgaatccatcaataaaaaataacagtgataataataactttgaagtatgctcaatgaaaatatagcatctctgcatacacaaagtgtcttgttttttataatgtaaagttggtctgtccctttagaatataaaataaatagtgccaatctcccttttcttcatgatctgaacattaaaatatttttttacttaggaaatttcagcttgctttactaaaggaatatttcaaacatacaagaaaatacagatgtcctctaaaccaactcatacagtgtacacatatttagcttcgccagaatcactgattcaatcagttatctattgagtatttactacgcattgaatcctgctctactgaaaaaaaagttccagtccggtgcagtacatatgctgttaggagaacacaggtaataaataataaccataataaataaactatataacataatagaaaatagtatgtgttacagaaaattaaagcagggtaaagggaattgtgaatctcatggcaggatatggtgataagactgcaattttatgatagggtggactcattgaaaaggtaaatttgtgcaaagactccacaaaggtgaagtgagctaggcagatatcaggaaacagcacaaagtccccgtggtagccagccctcaaggtcagtttagtgtggcagaggagtgacatggcatatctcttcttctgaaatttcactggggctgctgtgttggaaatagggtagaattagagaagtctatgaggagagtattacagtctcccaggcaacagttaatggcatctcaaaacaaagaggtatcagtgtttgtgttggcaagtggttagattctggatatattttgaggatagacccatctgaatttccagatgaattgaataccgggtgtgagaaagagaaatcaattatttattcatggttatcaggctgaataactggaaagatggtgtaaccattccccgagcttcagaagactgcgagaatgggaatgggaggtggaatcaaaaatttagatgttacaaataactctcaaaggagtttggaaatatttactcctactagccacgtatgagatcatgtgtatccctccatcagagttcacttctataatctgaaaactcgtgtctttaaattcagaaatacccacagtccttatcactcaataccacctcttcctcattctctactctctctttccagaacttttgtttgatgttttttttttttatagctatttggctctatttcatctattattactttttcatttcactatgctgcattctggatgacttccttaaatatcccttttaaattacagttcttcctacctgttgcctgatctgctattaagctcatttgctttttatttcaatgactataattttcacttataaggttctatttggtttcttagatccacccattcttttctagatgggtgtgttctttctatcatttgttttatcgctttagttattttaactgaagttattttctcatttctttcttagccttacattatgtcaatgacttcagatgctaattcatcttttcttttcatctgatcactccctctcacttgtgaatgatttgctttcatcatttacagttttgttgttgttgctgtggggttcccgagggtgaggaatatcccttgtgcctgggttatggacatgattctagaggtttggttttaccttttctttccctgccagctccagttgtttcacaggactgacatgagtgtctcatgaattggaatgagattgtccatatcataagtaaatattttaagtttgatccccacatctgcatgttgaagaggcttggagttaaaatttctcgcaggagacgcttctatcagaacacctaaaaaacaacaggcttccctgcctctcccctggataatggacaaaaatttccacaaaagaggcagcccttccggtgacctgctttcggccgtgatcttggtttctgatgccttcctgtgtgaggactcaggccgcctcttctggcctgaaatggacagtcacttcctaatctctgcgtgccaactggcaccaatttggtattacccaaaggactttggtatcagttgaagatctctttctgtttttttcacctagaaatttcctattctttctttccagcattgctatgatgttgggccttttttttttttttttttcaatttttcattaccttttatccaaaattatcagtttggagttagaagcggttaaataagatttgtgcagccggtggtgatatctgataatctctgtgacatatgaggtccttcaggccttctaagtgcctaaaggaccacttactttctagactgaagagaggcccagagtcctgagtgagggaccagtggggtggctgtttaccaaccaacacccaagactttcttagccatcagggcagctatgtggatgtgtatcagccaaatatcagactgcatatagtgagttttcttttcttactgctctctgcacataattcatattgtcatttacagcaattagataaggagctcaaaggaaaaacactaccccggggataaaagactgggaaaaaatatttggccattaaattattcaaagcaacatgaaactatcttaaagtctatttagattgctttgtttcatgaaatgagggagaatggaaaaaaatatttttaaatctgagagtcaatttcatgtccttactctggtacaaaataaaatacatattgtaaaggtacttagcattatagttactcacattttaattagttccaggtacttcaacatttaatcacaatttaaaaatcattatattcatacctttgataataggttaataatattgacattggcacttattttctagaaattataaagacaatcttggcatattcaaagaggcacatagattatatctgtaagaattgccattcaaatattttgggagtaaaacaccttttgaacaaacttgtgttttatgtctacaaatgtaattttagggcaaaggaagggttttggtatgcaggcttttctacctcctgaaagtggtagagtccctggatcccgggtagattgtaacaacctgtgtatttgagcatagaagatttatagattaatgtcaaggttctcagtgatgcctagagttaggcattatgtttgccttgccttggaaactacttaaaaagacctgagctgggtagtttctatgtgtctattatttccagcctttagccaatcagattacaagcaggggagagtagaacaggaggttgggttcattccgatatttccaaaattttgtcaaaaattgtttctgactccaaagattattcttccagcattagttggttaagaaaatgcttagtaacaaaaatttactattatttcagtgattgtggtggatgaatgttcatttccatgccaattcaatatatatttgaaaaatagtggtgtatgcaagctgttattaattaaattcacttatttaatctgtttctttgatgcataaacagattctgggaattgcttgtgacacctctttgcccgccagaatctggagttaaatgctgaaaactgttgttccacagaccgtagaagcaattgaacacatatgcaattatatgcaaaggcttttgcatataattcagctgtagttcagcttcatcatagcctgatcagctgacacagcaatcaccccaattattcaattttttggtctgacacgtttccgcagggcccacagcctgtgatgtggatgggataacaatcatagtaactcaaattatagctctttctctatctcgccacacagaacctcaacctcctataaaatatccttaaatttctgagagacccaagctgtgtgtctctcatgctcactaataaacttcatcccacagaactggttttgtccagttctgtcagttgtacaagtcctttttgtctctaggcaccaggagcaggtattagtcaggattctccagagaatagaacccagtaggatctatagggatatataaaggggacttgttatgagaactggcttgctggattatggaggctgagaagtttcatgatctgccatctgccagctggagccccaggaaagctggtggtgcaatcccgtctgagtctgaagagggtgggacactgatattatagtcttgggggggtcccaagtcctgagaacctggagctctgatgtccaagggaaggagaagatggatgtcccagctccagaagagagaatattcactcttcccctgcttttgtgttctatgttggccctcagcgaatgggatgttgagcacccacactggcgaagggggatccttttcactcagtcccctccattcaaatgccaacctcttccagaaacaccctcacagacatgcccagaaataatgtttcaccagagatctgggtatgccttggcctgctcaagttaagacataaaattaccatcacagagagagtataggcctgttcttcgttctgccctctgactaaagccatcatcctgcctgtgatggccggagccaccgtgcccctctccaacatagggacaatgcctgactgcccactctgggccacaccgtgcctctctgtaacctttgtgtgaacagctgcttgccttgccgccaacgggccaccctcctaagtgtttgcagacagagcctgggtccccaggcaggacagacaccatcctgtcattgccaccacacccctgcagcacctgtgtacaaacgccagcctccctccttcctcttccacttgaaacagaagcctaattgcaaaactattccacggagccctccacttaaactgctcatttatctgtcaggtgactgaaacatgcttgcctctcagggaagacactgtggttgatctgatattgcaaactgtgaagaaagttttcacatctatttgcccaccacgacaaccttaatgtgatgaaattaaagggaaactaccacttcacttccggtttggggagggaagtaattttgagaaaggaatgtgaatggcttgtttcaacagggaaagataagcaatgtagggctttggaaagatgtataaactacagacggcagcaacttaaaattaggggttaagaatgggctgcttagctaaccccaagaggcagtatatattcctagaaacaagggtaaaactgcctgagaatcatcagaagaggcgaattaaaatagtaattcagaatagagtggagaacagcacataagcaggagcgactgctgctttcatccgaagagcaagatggccgctcggagcacgtggggacgtaggaatgttatcatggttggaaagattgttctttcctcattcacattgtgaattggcctaaggctatttaacggacaagagcccctgctgtcctcaattttagttccgattgcctgcccgagacttcttctgtacaacttccaccagcaggtaacttagtcaatctgcttgtgtatgaggttggggcacctccaacctcatatacaagcaggttgactaagtggagtcaagcagatcaatgaaacgaagcagttaaaagtctgttctcatgttgatagagcactggctttttatatttcgttaattatctacaaaatacataaataatatctgtaaaacatttccagtacaacaaaacagaagttttccttgactctttcccaaaggtaacgagggtaatcaatttgactggtaaatatcaagacatttttcctatgcctacgtatacactcacacaagcacacgtgcacatacacacacacccacacagtctggagaaatatatatacacacatattttattgttcctttctgtgtgtgatcattttaaactttacatatacaaataggtccctattgttccataacttggtctcttttcctatttatcataaagataattccatgttgcacacttttgttcttcttcattattcagtttacgtgaatgtcaccgattgaaggaaaattaggttgtttttatttttcaccattataaatgatgatgcagtctacaccctcatacacacatgaatatatctctagaatatattcctggaagtaaatgaccaagccacaagtgatatacattttaatatttaccagctactgctcagtttttctccaaaagtctaaccaagttacactcacatcaactgtgtatgacagtacccacataaaaatacacccttgccaaaaatagatgttatctttctttttaccttttggcaacatgctagaaggatatctcacatctcagtttatcagaatccactcatctttcaagacgtggctctaaggacacctctttcatccacaccctcccagagcccctgaaagtggctccctacacctctgaattactgctaatttgtccaaacctctcattgcattcatcacattccattttatattatacttatcattagtgtgtattctaacctctgggttgagggcaaggccaaagaccatggccaatttatctttatatttatatctcccctaggtccttattttagtggcttttacattgctgggaggtaataatttgtaaaatacacaaatacaagaagagaaaaaagaatgaatagagttctattctaaatgaatcatattttataaagaatttgtgttacgtgtatttatgatttattctgagcaaactcagaaggcagtgggtataaaaaaggataatcaagtcgggagaaaatctcatagaaaatccactccttggttcatgtctgatttagatggagaaaaatatttgactccaactcacaattcttttattcttcctcagtgtaataagcactatggttacatcagaaacactgagttcaaatcccatgtaaatcactgaccgtgtttgtgacttaggaaaattcattaagatgctcagagctttgacttcctcatctataaaatgggcttcataataaccatcctagccgcaggataattatttctttttaccagagttgtttactcagtgcctactgtgagtcaggcacagaagctataaacatgagtacattgtgggaatcacacgagacagtgtatgtaaacacacttttaaaataataaattgatatatatggatgaggaagtactatgctacgtacacttgtgacaaagtctattttgctatttttaaaaatgcaaaattgagtaactaactgtcttctattgaaaaatttcattccattagaaaagacagatttattgttttaatagacaggttttatgattcacaagctagatattttcctagacttgtgattggtttttgttcaaaaacctatgtgagcgctggtatttctacaatctgtctctattcttcccgtttactctttcactaactcattcatattcttaaagatggttgataaaataaatcagtgaagatactgaggagtgttaccattctcttctttatgtattaaacgtctcattgtatatttgaaaaatgttacttataaagttacagcaaaattcagttcataaataaaatagaaaataatgagatcttacagatagttgcacctattttgatgggaaagtctttgctcctcaagttctcaagagccaaaaaagaaaaaaaaaatgccctttttgctctaacatgttgacctttgagtctaaattagtgcagtatcagtggcaaaatctgaactgtaaaatgaatctgttcggattaagggtttagctgttgcatggctaaatgggtcaagttctcttaactgatggatttatctgataccaccccaaagaggaaaagtttagattcaaacaaaccggccggctttcaatatttctagtatatcacactttttccatgagactcacaacctctcaagtttgggaaggggaaaaaaaaataaattcatacttgcagcttcttctctgagacagccttagtaaagaaaagcgagcactcactctcagggagacacagttttatttggtaactgaagtttgaaaactataaccggtaccactgatttgccttcagccatgcaataatttattccaatttctatggaggttacaaaacacacttaactcttaaggagaatatgaggttcttcatttgccaaatttaattcacggggggaaaaaatagagactataatgcttctattggttgtatatagaacattttaataggataagctgatataaaacgaatttaatttcttgtaaccttaagaataaggaaatgcttagacaaatttatcagctggcatacacagccaataaattattttttatataatagaaaataattttttctgtttttaagatggagtctggctctgtcacccaggctggagttcagtggtgcgatctcacctcactgcaacctccacctcccaggttcaagagattctcctgcctcagcctcctgagtagctgggattacaggtgcacgccaccatgcctgagtaatttttgtatttttttagtagcgacagggtttcaccatgttggccaggctgatctcgaactcctgacctcgtgatctgcccacctcagcctcccaaagtgctgggattacaggtgtgagccaccgcgcctggccggaaaattatgaaagcctttgtctgaagagaactagattctctggtggctgaaaagtacccccacccccactgtcttcaccccagtgcaaaggaaagtgtggatgaatgcagattttcccatttaatttccacaaagtatgtgttctcctgcctgggtttatattgctgcctaatgaaataatcagctagtatgcagtaggggagtgctagtgcaggaggggaggaaccatcctaaaaggtctattatcctgtcaatatgtgcacaggactctcattaatgttaattagatttacccgccagtacaaaggggaggctagaccttaaacagcaagtttgaaaaaactgatctagcaatgccagacgtagaaaaaaattagaaatcattcctgcctccaagcaaccttaactcatgtaaaagacatttatgtggccattaacccaagcagaaattgaacttgtcagcattacatgcagaatgtatatatgggtaaccgttcatgagcaattcctcaaatgaattaaatacaaactggatttatttctagacagtagaggtactctgtccatcatcttcttaatagaacaactgcaaaaggtttaggttttatagaccttttattcatgtttgcctttaaggcagaagactagggatggaaagaaagaactgctgttgaagatttggcttatgaatgaaaccaaaaacctagggtcatccttgtcttctctctttgtcacatagcacatttccaatccatctgcaaatcctattattttcctcaaaatcaatttgaaatcagacctccctttctttcacctgcacctctaccaccctggcccaactcaacatgtgtctcacccagattattgtaagagccataacctggaccctattcctccgcatgaaagctagaatgtcccttttaatatgaaagtccaagcctgccattctctacgtatccccttcaatggctggccatctcactcagagtgaaagcttcacaatgatcatcacaatgggcctgccctcacccacaccctctctgagttcacaccctccacgttcctcctcagtcctcctcagtcctcctctcaagccccctgcctccctggtggtctatggttgtgccaagtgacctctgacctccaggtctttccacttgttgttcctctccctcaaattcacttcctccaggcctctgcacagccacctcctcggagagcccatacctgaccatcctaactgaaatagcaacctcactttttctcaggtctctgagcctaagccaagccatcacatcgcctgtgacttgcacgtatatacgcagatggcctgaagaatcacaaaagaagttaatatgccctgccccaccttaactgatgacattccaccacaaaagaagtgtaaatggctggtccttgccttaagtgatgacattaccttgtgaaagcccttttcctggctcatgctggctcaaaaagctcccccactgagcaccttacgacccccactctgcccaccagagaactcccctttgactgtaattttcctttatctacccaaatcctacaaaatggccccacccttatcttccttcgctgagtcccttttcggactcagcccgcctgcgcccaggtgaaataaacagccatgttgctcacacaaagcctgtttggtggtctcttcacagggacgcgcatgaaacttttcacttcctgtattcccccggccttttcctgctatagtttgctccattgcatattaacaccatgttacaccatattaattgaacatttattatgcaattatctgtcccagttgaatggaagctccatgaaggcacttggtctgggtccctgctgttggcccagcaccctggacagtgcccaaaacacagtggacactcaacaaatgaagtaaaatattgttgtgctcattgtgggcacattgtattcatgcactgttactaacaaactgtgaatccattttctcaacatctgaaaaattctccaaactacattaagagattatttaagaagatacaaccagacacagttgctcatgcctgtaatcccagcgctttggcagtctgaggcaggaggatcactcaagcccaggagttcaagaccagcctgggcaacatagtgggatcctgtctctacaaaaaataaacaaaattagccaggcatggtagcatgtgcctatggtcccagctactcgggaggctgaagcaggagaattgcttgagcccaggaggtggaagctgcagtgagccatgatcacgccactgcactccagcctgggcaacagagcaagatcatatctcagaaaaacaaaaacatcaacaaacaaacaaataaagaagatacagccatagatcagctttaaaaatcttaatttggataatgttatttttcccagttttctttattaatttcccacattggatgcttaaaaatatcttttgcactcaatgcctttcattcttcagtgtcttacttgaagcccacacacattttttttcttccactccaagttcattgaacaaaaacttgcatatgggtgacagcctctattttacttttgttaaccctggacctgtctcaaaatcagagtcgcaaagagaaaagaaccaatgtcttctagagcatatcagaagtgctagaaacaggagctttagcatgagtgtacagacctgaattatgcaacctactggtttttacatgtgacatgttgacagaggttgacacttggtgagtaccgtgtagttgtcagctggcattaagacttgcagttcattctgtagtcaaaataaaggaagaacggcaaagtccatatttgaaatccacacttcaggatcatggcagcctacagcatttctgctttatctacagtacccagtgcccctctgctttgctgtgcttggagatggacacatgtaaactcaacaaagatatctattaactgtttatacctaagtgcatttgttcactgtggtcaaaaaagtacatttttctcatcaaactggtacatgcttttcttaagttacttacagttacatgcaacagcaaacaaacgagagagaacagaatatgtctaacagaaaagaggacaacaattatgattttagtagttccaggaaatgtaatcgaaagctgtaaacctatggtaaaagagttcagggagtggaaattgttctttatatattgtagggtttttccatgcttgctgcttgtctagtgggatatgttttgttttttaaaaaacttacttgaaagtctgaagtattgctgtattatattgtatggtattatagtcacagaattagactttttaaagaactgtggtttattccatccttgtcataatgcctgtcgtgaataaagcaagcttttaaactcataaaagtaattagggatgtgatctgtggaaatacttttacattgttataaagctatttgtgttgcctttcttttggaagcaaatcatcgtgtgtttctaaattggggcctttttcttcttcttttaaatcggagaggttgtgctttctttgtttgtataatgaataagagccttatctggaaattgttgcatagcccattccattttaggtagacctggaaattcagtttcttctttctctgctaagtgaataaatagactgaggaagtcttctacctgtctgccgctggtaattgaattactgtacaacacattaagcaaagaaaattcagagcagcagcaatcaaattatgttctcatgttccagagagtgggctcttcacagagaatgaggagacaaaatgttgtaaagtgatagacaccaatattcggaagggaagaaagaagacaattcattaggccttgtgctaggcccatcccacgaacaactcagaagatataatgactcagacagactttagtctgacttatttcctttttgggctgcttccagctcagccaacacacagtgcagaggacacgtgagatcaacatacaagtctgcaggcaggactccctagatttccttagggaagggcctcagattcggagatcagttgagcttgcacaaagtgaacattgagccgcaggcgctggggggccaaggggcgtccagagcagagctgtcactgttttacattcacctctaattaggaaagggacctcatcctcattccagagtctttttactccctggctaggcctttctgtcctgggccacagttacatgcattcaacagtcattgtggccatggccccacgggggctactgatgcgactgattgcacatatgttatctcattaactcacacaaagatcctgaaacacgaggtttatgtttacctttattttgtatacaagaacactgaagtgtaaggggtgacatcacattaatcatagcggttaccacctattgtgtatttaccaattgctaagtagtgtcctaagtgctttctatatgcttcaaatttaatcctcaatataactccatgaagtggatgctcttattattatgtgcgatttggataatgatgatggccaccaccaccaccaccaccaccatcatcatcatcatcatcatgatcatcagtctttgtgaatgtcaagggaccatacttcatcacttcaacacataggaaggatattttatgtatctatactttgttatatgcatgaataagcatgcatgcacatacccacacaaacacacacacatcagcccactaccatcatatgttaatccccaggctgtcctgctacatcgatggatacagcaaaatggcaacaaaacaccaccagctcatacttacctccacctgcttgaggtaggtggtgggtgcctgtaatcccagctactcgggaagctgaggcagagaattgcttgaacccaggaggcgaggttgcagtgagccaagattgcgccactgcactccagcctgggtgacagagtgagactctgtctcaaaaaagaaaaaaagaaagaaagaaaataacatatgtgaagaagctttataaaccatgagtggaaatataagctcaggattgtatttttttaatgttttattgacattcaggtataatttacatataatagaattcacccatttaagtgtgtatttcaataaattttgacatatttatacaccatgaatccagtaccacaatcaaagtatagtacgtttccatcaccctgaacgttttcttgtgacccttctcagtcagtcctacacatctgtcctccccagcaaccacagtcttctgtcactaaggactggaaggcacaactagcggcttctgtcactagaaattagatttgcttttgctagaatttcatttaaattgtcttatactgtatatgtgtccatgtagttgcatgtatcagtagctcattcctttttattgctaagtattattccattgaatacacctactataatttgtttatctttatatttgttgatgaatattttcaggttgtttccaatttaatctactgtgcatagagttgctatgttcatttgtgtgcaagtttttataaggacatatgtcttcattgtctttgataaattcctagaggtagaattattgagtcatatactaaatatatgttaattttataaaaagctggaaaactgttttacaaagtgtttgtatcactttgtattcctaccaataatctgtgagaattccagttttttacaaattcaccaacacgtggtatggttagtctttttaattttagccattctaatgagtgtgcagagataaatcattgtgactttaatttgcatttctatgggctaataatcctgagcttttaaaaatgtgtttattggttattgtaatctttatttgcagatctccattcacactttttgtcttttttattatttgtcttttattagtgagttgtatgcttcggttatatattctgattctagatcttggtcagtggcttgatttttcattttctaaagggttaattctaacgaatgtcaattttgataaagttttttgtttctgctttttgcatcctaagaaatattaatatatgcctatcccaaagtcaagatgattctctgtgttccttccagaaattatattttgagttttcatgattggatctacaactagtataattctgtattttgagttaatttctgtttatagtttgttataaggcatgagatacattcgttcatatatatacacttatacacatgcagttttccagcactgtaccaaaagagcatccttctcccattgaattaccttagcaccttttctgaaattcagtggccacatacgtatggttctatttcttaaattgatatttttagtttcaacattgcaataaatattacataagactttttaaaaatctccttaaccattaactgagaaatttatctcacaggtttcttgtaggttaaactcacgaagctgtagcttttttttattctaggacataataattatacaatttggagggattcttattacattttcagataaggaatcttccactggatatcccattatgggaggggaaggcagaatttagtatatttgtaaacaatctgatttttttcctcacctgcttccttgcccttccctagcactgcaggagtggctacctgaattgatgtgagcctgatgctcaagcctccctgaagaagtggtctttgggccaatacttgaaaggagagaatcagccaggaaaatgtctggaagactataccaggcagagggacagcaagtgcaaaggcttacagtcctcttaccagccagagagagcccctgcaatagaattactagaggtgcagcaaatcatggcaagaaggggccagtgataaaaggatggtctgatggcaatctagcacatgttgtggggaggggaggaacaagggtttggaaagactacttgggcacagatgacaaaggggcgcaggtcctagatttagcagattagcatgaattggttgacgatagggagccacttaacgaagggctgccatggtagaaagagtgctttaagaagattcagagccatcttgcatagggtcactgctagataattaactatttaattaattttccaagtgagtttgagtcaggaaagggttaggtggtaccagatcagttaggaggttattgcaatgatatacactaaggttattctcatgggcatgaaaatgaaaggaaccaaacaagttggtattacatgtcaagactcagaagcacttggtgtcttagtctgtttacagaatatcataaactgcatagcttataaacaagagaagattttcacaattctggaggctgggaagtccacaatcaaggcagattttgtgtctggtgagggcttatttcctggtttctagacagtgccttctctccgtgttctcacatggaagaaggggtgagagagccctcagggtctccttcctaagggcactactcacattcataagggctctgcttccatgatctaatcacctcccataggccccagctcccaataccatcaccttgggtgttagggtttcaatgtggaaattttgaggagacacaaatatatagaccatagcacttagtaattgaaatataagagcaacaattcatactctcagaatattgcataagtgtcttccattttcaatagacacccatgacaaaagttgtatgccaacctctcatggtatgagtatctatgcctttataatgtatgttccatgagggcaggtgtttttcttaacttggttcactgctatattccaagtagctagaagagtatgcagcacatagtaggtattcagcaaatgtgagatgaatgaaaagtatccaaagatcagacaagtcatcttgaatctgaaaatgatattataaaatcatcattactgtgctggagagttacaagatgtttctttgattacttgcacaaatgcaaggaaatcaacacttggcattcttcggattcccaaggctaaaaatttattggggaggtgatgaatgtcccagccaaaagaaaaagctacgctacataatagatttcagatgctataggcacttgctttattaatagtactgcagatgtgttatatttatctggactacatatgatttagattaacgggcaacaaatatttattaattcaaacacttttcttatttagaaggcagtcaagttatgttagtaaggagagctactgccctaggatactacctaaaacagcagaaggaaataatcagatttttttaaactttaagcgataactctgtaaattattctcactaaaataatggtatctggaaagtgaccatttttgcttgttgatttcagttggcattgctggaatgacctatctcctgtgtcatctgacacggcaggattcgatgtcaatgcacatgctgcattatgaatgtttcagagcgtttgctctaatgtaaatccatgtagactgtgtaaagatgctgttctgcacagtttattttgtctctcggccatagagcactaagccctggacattactgtgtacaatgggttttgaattccatgctcatggaccacggccagcatcacacacagaagttaatgaccgattgttatcttagcccatagcttgcattccttttcataagactatttcagcaagggggcggatcacaaagtacaggattaattaaggtcaaatcccagtgaaacgtgcaatctattttctcaaggaaggaacttggaagaatcacagggtgaattttataaaccaaaacccaatttttaagataatgtttaattaaacttgaagcttaattttcttcttgtttaaagagacagaatagtaatgcaacataatttaaatgtgccagtatatcagcagacgggaaacatttatcattgctgtgaactactgtaatttacaatggtgatgggccaccctgaacatcctaacaattcaggcatgtctagatcatccaactaggcagacactagtttgctaacatctgacagtaaaaattgatctttgggaaaccattgaatctgggtccagtggtgtactgttatttaaaaatttgggttttgatagagaacgaacaatgaagtcaaccttgtggctcagcgcactaaatgttctcatttcaatgtgttgtaaaaatgctgatcccacccaactgggattatagtttcggattgtgctgagtttctggaatgcttacaaaatatgtttttctttgggtattataatgtcattttcttctaattatctcctgataatttttcctatcatattatgaagtcttggaagaaattaaaaattaaccttctccattaaaactcacaagtaagcttctttgaactaaaatcctttgcacatttcaagctgttcatactgttaaagaaagtaaattatacttgaagggtatacttaaaatgggaattttaaaatgaagattatctgcctttcttcctgaacatagacacataatcttgcctgttctggttccatcttttccaatataggcagttgcaggggtgattaagtacctctgcagagaaagttagagtgaaaatcagttcaatgataaattaaatgacagattttcaggtctttttgtttgtttgtttttgcttttttggactctattatcaaacaataagaattagactttctagttgcctgatagtttgtaaactatttaaactgtttggaatgcaaatatcctaaattaggattagagtaactgtgtcaataatacagtaatgatatgagtaaatcatacttgcttcactctacatcagatagagttttttaataattttgtaaaattcctgagatgtttgaagctgggcatgttgtctaatatttatgggctttggtttctgcctgtgtcgagtgggtaggctggaaactgcttcacagaatgtctcccttgacctcaagccagtaatatacagccctcccatgtccttcaaaccaccaggagttgatccccaagagaaaacttcacatacacagtattcatcccactagaatacttgattatacattgtagaagccagtgacagtctcccctcagtatcatattctcagaatctagcagaatacatactacgacacagtgaaaaatcaatatttattaaataatgtaattacctatttagtgcacagggttaatggatgattatgggggagaatgtatataaacgtatttcaataactatatctagacaatgtattgattcactaataaaatcataatacacaagtataattatactataaaaatccttgaggtgaagaatcagagcattgaatggttttttgttgttgttgtttgtttggtttggtgaatcgattattattaattttagtttcagaatcaagtattaaattctgtacatattatatcttcaaaaaattgttgttgtttggttatgatacactgaactcaaatgccatttcctctaggaagcctttcttcaactcctcatctaaatttggtgtcccagtccccacattccaggcccccagtggtttttgtcctagctcttgtcatactttgtaattacaggaatctatgagtatctgttgactgcccgtctctctcactgactgactcactcactgaagctgggggcagcctctgtttggataaccacgtagctccagtgtctgacacagcccctgtttcaacaggagatgttcattatgtgtgaagaaggaagggagtggaaaaggagcaaatgaagaaaagagtagggaggaagagagaacggaatacaattgtatatttaaattcaaattcagttaatgaatttaataaatccagagttccattaaagcaacaaagggtagccagcttggttagcagatcaccggcatgccggcaccccacaccataccttttaatctttttctgtcttttcacttgggaggggggacatcttacataccaacaaaatgttgaaagaaaaaaacattaattcatattacagattttatattgttggtgatgtattttcatttaaaatattccaaatagaagttttaaaagccttcaaaagtagaaatatatggagttttggcaggtagtagatgtgagtcacataccacttaaattggtatttaaattgtccatataaaatagacattaagaaaactaaatgcctatatcctaaaataggggtagagaggcagaagcaactaatgtttacatcctttaaactggaatcttggactttatattgcaaaagcaaatgacaaatgtctaataaagttcaagggcaagttacacagatggaaaattaatagctttatttttctttgtgttaggcatcatttcctaaacatttgaagcaaagtgtatatttaagccacatttggatttatcattgacatcttttaaaagaaaaataggaattaaaatgcaatttgtgtatattcttatacttcatacactttccatctatttagcattaatgttgtaggaagagctattcttttagaaaatgtcaaaaagaacaaatttcctaaaatgttcctgttgatggtaagtaggctgttttgccttatactaatgtaatggattctctcaataataggacttttttttctaatttttcaagataattttagtgactcataatcagtaaactaaaggataaggagcgacctacctcaatgaaaaatatttcagtacacatataataccagccagctatttcttgagggcaactttaaatcgaagtcaagtcacaaatggattgagactggtgatctcacttcatcctttggaaaactatgtatatcacaaaatcagtatacattttgacatagttggcagcctttccttgaagtaggctctgaatcaactgagcatggaaactcaatttgcctggggatatgctagcctttaaataaagagggctgatagtttctgctaaaacaatggagaaatctcccaacatctataattttgtatacactataactctaacagacagtctaggtttcaagtcatcaactgcccgtaaaatcattatatatactttttagaacagaagtatggtaaatgtacttttaagcttacttgaccacatatttttttagagtaccaatttcattacatattttcttttatttctcccacaagattatttttgcgtcatctccccagcaactctggtcatatagaataccaccggctgatcacacagctctgtgacagccattgcagattgctaatggtaaccctgcactagggaatagatggctttggatgtctgatctagcccaggggtgcaaagggcctgctcagagagggcatgatgaagctcctgaggaacagggagacccaaattaggaataagaaaatgtggaagcaattatccatgggcacccactaccttaaaataattggaaccactgtgcacattgcttaaagctacctgatgcttgctgtcaacttgtgtctccacttctgtgctggaactgagcaaaataaaggagaaaaggtcaagcaccacgtaactaagccaaacttcaatgataacatgcaactgtttgcaattgttttacatgggagtattttattatttcatcatttaaaatgaccttggatcaatgcactcagaaacttgggtaggcagaaagaatttatttttcaagctaccaaacatgataaaaaatatagtttttgtggttttttgttgttgttgttgttgagatggagtctcactctgtcacctaggctggagcgtagtgtgcgatctcgactcactgcaagctctgcctcccgggttcaagccattctcctgcctcagcctcccgagtagctgggactacaggcgcccgccaccacgtccggctaattttttgtgtttttagtagagacgggctttcaccgtgttagccaagatggtctcgatctcctgacctcgtgatccacccaccttggcctcccaagataaaaaaatatagttttaaatgtttttcaatatatctaatagtcaacatataatgtttctgtaggggtttctataaaatctattatttttggatatttcaacatgttggcttatacaactttcacatagtttcttcaaaagagtaaagatattgtttgttccaccataggcctactgctgctaagttttactttccttttataatggcaaactactaatttgttttagaaagataaaatttaaattttaagcccaaatctttattcactataggtgaaaatgttacactaagacccaaaacaggttagaaagagagaaaaaggaggcaaggaagaaaggaagtaggcaggagccagtctacattgtgagattatcatttttatcataactgtgttatcacttagaaaaagacagcttaaaagcagattaaactccagtcaatgtgtatagctctagctaacataaattagacataagcaagtcacctaaaattaaatactcatactatattttaagttattctagttgcctctcccactctgattttaatgcatccaaatcctttttatcatatcaatgaagtttgaaaacgtcagccaggatccaaattccagaattttattaacagcaaatagttgagtaaagtacttgtaagatgggtaagcagatcggatctctgtgctttttctcctgtaactcagggtctgccctctctgttgcatgcaatcaagcaccataggtgctaacccattggtggtagcagttttggtattgttgtatctgcaacttgaagtggataccatgccaggaaagtttgtttcccagatgagtggattaaggaaaggaatttggtttggatgaaacaggttgttttggtgccaaacaatatccagctgtatggcttaagagctcgtcgtattatcttacatgtgataaaacaaccagtataagttacatggcgtgatgatcacctttttaaaaagacacacaaattaactactttctttttgcctccaaagtaaagcctacagtcacagccaagtatgtagaagacactccagtgatgcttgaagtaagagacacttcattcttgccaggttcttagcgtctcaaaattcaaatgccagtactcaaataccaattttgttatcaacacgtagactaaaggaagtgaaataaaattaaataaatggtacgtaaaatttcaaaaaacaaatctacatctatctattgagtgattagtgagtggttttctttaatattgaattgctacagcctctcaagcaagagcagttctaccctttattccagccctggagttgtaatgcacctcaatactttccagacagaaaagtttattttattgaatactttgacatagattgtgagctggtttctttgaatacattttagaatcgatttcttctgaagatacagcatattaccactgtagcaagagaaataattagatttggccatactgcttctacaaaagctgtctcaaacagatggggagcccgatccgtcagtggctataaacaaataaaattcaaaataatgctatatgtcagtaagacaagtaatttattaaaagaaatcaatgactagttgaatataaagaagcttccaattgcatatttttgttttctacacttctctttcccttttccctcattctttcactctctttttgtctgtcatataactctgcagagcttgcatgcagcaatattttcggttaaatttcaaagctggatttgcccaaaagaacaaagaaagctgtttttaagctttgatctcatcatggagtttccattctagaagggatatagatactgcaggccaaatatggccctgattccctaagaaaatatagtaatttgaattcagagggaattggaatttttgcgtgtatgaggaacatgttggcctcatagcttcaatcaacaagttctgaacctgaatggcccaaagtaagtccttcaatgaactgtgtatattaaatccaagtctccatcttcaaaagcccctagcagtggatagaacgcaaagatgaaaggcttggtgagaagagataattaaaacttaatgggtgcttgttatataagtaggtgcaatgaaaaatgatcattttaggtattcacatggaattcataaagagtcccgtgtgttgtaagtaattaatttggggtagttaacactaggaagatgacccctaaaagatatgggtcaaggctaactgcccaactccctcttctgttatggtttatgggatgttttatacttgatgtaagaaaaagactaaatccaagaaagctggagaaaagctcacctctcctaaaattttctattgaattgattcagactaaagcaatgaccttccgattttttttttttttttgaggtctctcccaaaagtccccggggattaaggggcataagatgtaccttgaaaaaaaaatagactgattagggcctttgaccagatggtttcagaaattagaagtatctcttgccttaggtggtgaccacagaggcatttgctccaattgcacctagacacagcctctcaggaaatggccaatcccccaacaaagtaagatatggacttagggtgtcaaaaagatgaggggtaattttacaaagcttttagaacttcaatctccggtaagctactgtatctgtctagtggcagctacttttgtttgtgtgtgtcagatgactctagcctgaatgagctttttcatacacgttctgtttgaagaaaagccttgctgtgttccttcttttgtcattcctgtgtctgtgtagtacagtagcattgctttctcccaaccctgccatccctcctcaattctgttcttcctctcttcatccccccaacactctaagttccttaatgttgctagaaaaaaaaaaaatagccattctgatctcaaattgggaataggctgatcgggctattttcttcttctcgtctatatgacattattggtatactgcatgcactgctgaatatcatcaacatgggacaagtaccagcagggattcggttataaaacacgtatttgccaccggtgagagagtaaacgtagatacagggacaaacatttacaaaacaaacatgaaacttaaaatggaaagggaaagagaatgcagaataagatttacactgatccactgagttccaggagtgtctatttggaaagcaaaacccctttgacgaaaaagttcaatgtggtatcagtattagccacgttagggcattttcttgacaatctaaagtgtctacgccagtgaaacaggaacaatggttcagagaaaggcgacagaacctaaaacttgaaagtaaatttctgaaactaaaaaatcctaaattttctgttagatgtgtaaaatatttcctgatacaagtttgctgttgtaaagtttaattataaaattatgaaaataaattcatttacataggtaaacaggtcataattagtgtgtgctgttggaagagacaattaacttcctccttattttaaaaaaataataataacaagaagtcatattctctgcatttaatctttcgtctttctgcttctccctatgaaaagaaagccacaggacttcttgaggagagagtattttgataaagacaacaaaagctctgaatattttaacttttatcatggacgttttcaagcatattcaaaagtagcatgtacatattgccgatctgggttcatttattccttccagattatttattatctatttactgctgcatcactttaaagcacattatttcacctaccaatacttccaaataaagctctcacagatgaggatgcttatttatgaccctcccatttgtttgcttgttttaataagaccaccatgccattctccaaccttacccccaataagtacttaatggcagccaacgttcagtccatctggaaatttctctgactgtcttaagaatgtcatgttacaattagtttgtttaagtcaggctccaaacaagagtcacaccttgtatttttctcctgtgtctcctgtattctatattaatctccatcccctttttaatgccagttatctgttgatgagattcagaatatttttaaaagagaaggtgaggcaagaaattccacctctatagagtggctctgtgtgttctctctcacatcccatcacttggagtgatgctaagattgatccatgggttcaggtgttgtctgcctgatctatccattagaaaggtccctgtcctttcaccttgaagctttagtatctttggatgattattgcctagagccattattccattagggatgacaaaatagtgacttttataagctatcagcttttatcaatttcttaaaatgcctgcatatcaatttgactgtagaccagcagctgtgtcattctttgcatagataacaacaaaggctgtggttatttttgacacccgatgaagccacagacctcatgaagtatcatggcacacaaatctcagaaggggtgtgactggatgttgtggagagtgagttacacagggagatttattcagcagatagcaaaatgggctctgtgtcattcagtttggggtggtggggatgaaaaaacaaatcttgccccaggcatgagtctgtcctctagacatttggtagggagccatatggtggagtatttttctttacttaatattatgaagtcattctccaagctctctgcagattttctctattagattatctcagaaggccacagctaatgttgagcctatttctcactttatataaaagtcaagcaggcagaaggctgaaaaatccattcaagatttcacttggtgtcttctgtcttccccaaataaagccaatcaaggagaataaaatgcgagctgaaatcatcttatctcccagaagccccaagggcagatgtaaggttctggcaaagaattagtaaaggctccgagaatgaaataaatacttgtttcagatgtaatttgaagacattgtggactaacagcaacctaatctctgagagaataaaaacaagtctgtcttttaaatgggcaagacccttctcacaatagctagtaaattgactcccacttctactgtgccgctagacacaaaagtgacaaagcattatctttacttggtgatgggggctcttctttgacccacctggaccacctattagtgtataaggaacacagctagcgttctctagcccttccagaatgccatatgaagacaatctctctcttcctccttcttctctccctccccttcgttccctcacaccatatctctctctctctctcgctctctctctctctctctagcatgcatgtgccacaccaaatttcttttcatgcagttatgtaaacagcagagactttgcatgaaagggttccttccactccctgcttgtctacttcatctttttcagaaactgcaaattacagacatgatttggatatgtgcaaagacaatgcttttcctcaactttgcagccttatttgagatacatggggcgcaggttttgaagacaggagaatgaggtccaaatatgggtccagcacagccacccatgtgtcaggtgatcctacccagttctgtaacccccagcttactctgctgcaaaatggagatatgacatttatttttcaggattttcacggggctttgcgttttgtgtgtaaaagagcacgtagcaagtagaggatattcaataaatgactcaacaagtgtttgttcctcctgttaattttttttggaaatgtccaattcctatcaccggtttaaaagccattaagtttctttatctcatgaagcaagtgcagtctttaaacaaagtcccctgactttcccatgctggctttccttggggcagtgggcatgtgcctgcttgatgtcactgtcactttgcattgctggctcggcccttgctacgggctgatgatttcttcccaggaggagtaagagggccattttcaaatctctaacacatttccccatgatatagcacaaactcaaacccctgagatttttagtgactgtaggatagaggctcagagtcaaacagagtgaggtatggttctcccaactcagagccaccgacgtggctggcgttgttcagttccaccccccaggcttacttctggaccgaggcctgaaatatttcacacagtttggctgctccatcgtccttccaagtgccttgcttgagatcacagggcttttcctttgttgtgaggctcaaactcatcctctctatggccagggagtgtgcatcgccctcactgatctcttcacaggaacttcagttctgctcccaaattctagtccattggtttgagtcttgctgaacgctgacagactttctggaggtcctggtattccgagcaccagaagcccagattgggtccccacaactcaatgcatgatgatggatggaagatattcagccacttcacttgcctgagatatgtgtttaccaggtgtgagacctcctgttatgcttcaggagacctctcctgaactaaagtttccttcagtgacccaaatctgcaccttccttcttggcttgtgaattacatgcttggtcctccccagtaggtcgtgtccagccatacctggaggaaacttaaggcaggacatgtaagttcagaactggcattcgggccgcggttgtcactggctctcgccaggtgagggtcatctgccactgagacatggaggggacctcggggttaggaagctcttaatccacaactgctctgccagtggcaagaaacaaagaaagaatctagctctttctgttcttctttggtttgcttccagcgttttcctcttgactcataaaacaaaaagctcactgatgaaaagcatctagaatgctaaccgcagagaatacagaaaatgttttaaatgaaaagaaaaatgactaagaatcatgttacctatagttcatcattattactactttggaatttgtctcaattcaatgggtataaataaagtctcagttatacaagatgattaagttctagagatctttcgtacaacattgtggctatagttaacaatagtgtattgtatgcaaaaaaattctgttcacagggtagatcttatattaacttcctaccataaatttttttaaaaattggaggaatcattacatacacacatatataaatatgtgcctgtgatatgcatgacatatgacatctttgtgtaccacacatactgtgagcattaactagaatacctctcttgtctctctctctctctctctctctctctctctatatacatatatatgtgtgtgtgtgtatgcctctgtgtgtgtatgtaataatttcccccatacacaaacacacacacacataatttcctttttaaaagttagcattagcttgttaatttttaagcttcaaaacaagtgatgaaaatttacaggatccagaaaatccaattaggcgtattgttccactgccaaacacgttacaaatgttgactaacactggtgttcattgataatcacttggaagcttgcccttgattatttaaaattactaaagtcattcatgttttataacaactctgaaaaacactttgaacctttaaagatgttacagttagccagctggaaaattctgatttaacctctttttctatgttgcgacatcagtcagtgatttaatgtgtctgagtttctgggccttcatctttcaaatgggaatattgatatatattgagcataaaatgtggtagaatatgtttcctcagtctttctcaacatttttgccaccgcaatatgcatgacatatgacattttcaggtacaacgcatactgtgagcattaacgggaatacctgtcttgtctctctcacaaaagtaaatgtgttagaatgtaaacaaatgcaaatgagttcaggatacctaaatatacagaaataacattttctcagttacatccatcagtgtttgacagcaaagagtttgagatccatcgtgttaacgtacataataaattggtaagcaccaaactgaataaggtgctattatttcagtaattacattaaagtagaaggtctatttctcattttgcagaaatctcacccaggtgcgtaaacattttgcaagtttggataccacctgacaagaaacaattaagaaacgcagtatttaattcgttaacgtgttaactgatttaaattaaagataaattaagctgtgttcttcatttattagcaagattcaagtaagcaaggctttgagaaatagagttgagtttctttatgactgattttaattatgaaataacttgcaaagacagctccccatttgttctatttagaataatttcagaaagccaatctctgaactatagttgatagctttcagaaaacaacttcatctcaaatatttgtttattgtaaaagctaaatagtattcatctagacataattctaacttttattgattcataaaactaaattaccagtagtcatttaaataataatgagggttaaaaatatgtaaataagtaattgctatacgtgaaatttccaaatatttgcaaaacggagttatcattaatgagaattcgctgtcaggatctacagcaaattaggtcactattattaaaaggctacagagcagtaaaattaagctttcaaaactacctaaaattatcattgccgaccttaggattttctgacagaaactttatcccaactatcaagataaaagaaaaaaaatactcttttgtctatcgtcttgaaactttcacttcctgtggttcagtctgaaagataatgcatctgcttaacatcaagcagtttttagaactctccttgagaatttttccaccatcagtgattcataaccacctcctttatgtgatcgtatgatatatcttttaaagtctacattttaaagttatttcaggggcccacttaatcagggttccagaggccatgtggactctccttcatctcctccccacttggatttttgtctcagcattcctcagcttctctgctgctggcggctcaaacaatggtatgacagcaagccttggaccaaaagaataattctgggtttgtttcataccatgtatctggggaattcaaaataaataaaaataaatgatatttttgtgagctgcaaatacatgtcctacaataagtgccatgcaactaggaaagatttttattaagctttttttcatgctacagttccaatattggctggtttatttttcattttcctcagagaaggggtctcactctattgtccaggctggagtgcagtggtgcgatcactgctcactgcagcctcgaactcctgggctcaagtgatcctcccgcctcgagctcccaaagcgctgggattataggcctaagccactgagcccagtccaattattggtaatttttagtgatattcaggaaatatataagaccgtcacaaaatgagcatttattatccaacacaacagataatgtttttaaatcaggaatgggattggaaagaacagaataagctccaggcaagcaggaattaggtctgttctgtttgccccttcatactctgtacctagcatggtgcttggcatgtagtaggctctcaaaaatatttgttaaagaaagaaacagacaaaaaatggagggaggaagaggagagagtgagaaaaagcagggaaaacaaaacatgatccacatccaaaatcatggtgcagccaaatctagaaaaattcatggcagagtaatgcttaagagactttggacatactaacttaatatagttctaccctcttattcgtcataaaacagaaagtccagggatggggaagttgttgggtatttggttttggttttggttttgtttttggagacagcgtctcaccctgtctcccaggttggagtgcagtggcatgatcatagctcactgtaacctcaaattcctgagctcaagcaatcctcccacctcagcctctctagtacgtaggaccacaggcatgcaccaccatgccctgttaatttttaaaaaatgtttgtagagatggatctttgctgtgttgtccaggctggtctcaaagtcctggactcaagcgatcctcctgcctcggcatcccaaaagcactggaattacagtcatgcaccactgcacctggccagggatgggaaagttgacatagccactgagaagcatgtcagtctgagctaattgaattaatttgaccataataatatcggcaacgtctctcctaccatattggtatatgacttatggttccattcaggaagattacttagcaaactgcatcagttttttttttttctcttcatgctacagaggaaattgagataaaaggtatgggaaactactttccagagacttagttgagagagaaaatagcttaacatctctctgtaataaagaacgggccagatgtggtgactcacatctgcaatcccagcaatttgggaggatcaggcaggcagatggcttgagcccaggagttggagacaagcctgggcagcaagataaagccccgtctctacaaatataaaaattagccaggcatggtggtgcatgcctgtagtcccagctacttgggatgctcaggtgggaggattactcgagccagagaggtcaaggctgcagtgcagtcaaggcaagtcaaggtcagatcatgccactgcactccaacccggatgacagagtgagacctccttgtccaaaaaaaaaaaaaaaaaaaattcaaactcattcctccattattagaagcaagataacttattaaaatgctaaccttgaaatatgagtttgtgttccccagaaagatcctaaagaagatggctagatgacactttagggaggctgaactcttagcaatgaactccagtctccctaaaaattctccaagtcacagagaccagagacatgtggagacaacatgacctgggcagtatctttgactggtgcccagtgattgcagggaactcctcagcacctgaatccattgtaagtcacacaatcttgaccgagattgaatttccagatcccagggacaacatgtgttggattcaggattaagttgatctacagaaaataaggaaatgcagtattctaagctcacttgagtctgtggattgggattcctattcattacacattgttatacacattaattgatcacttgctctttacaagacaaaaaacttggttttgccaaaaaaaaaatccctgactgcagtggaggtgttaagcagaccttgaggtatgaatctagtccattaataggccaagtggagcggcactttattgacaaaactggaatcaaaagctataaatggaccataagaatgacagccagggcttttatatgttataatattgacaggaatggtgcaacatcaaaattaaaaacctgacatcattgaaagaataataatttatttttagatccttcctcttataacatatgcagtaaaattctaaatgtgtgcaaacaactggaaggcatcaatttttaaatgttttaaatttgccatcgctggtctaggtgcttgggtggcatcagtgaacaaaggatgaagattctacctctggtatctagggtggatagaaaacaaacagtaagcatgacaactaagtaaattataacaagttagaaactgacaagcagaaaaaaaggaccctgagcaaaagaaccagagcagagaaaacggagacggaatgctgttttaaatggctgggcctcaggcctgcaatcccagctttgggagattgaagcaggaggatcgcttgaggctgggagtttgagactagcctgggaaacatagtagtttgagactagcctgggaaacatagtgaggccctgtctctacaagaaaaaaaataaataagactatttagctgggcacagtaatgcatgcctgtaatccaagctactcaggaagctgaggcaagaggattgcttgagcccaggagttgaaagctgaactgagccatgactgtgccactgcactccagcctgggtgacagagccaggccctagagctaaaaataaatatgaataaaataagtagaatacagtcaatggagctcagggtaggtctcactaggaagatgatgtttaagcaaaggcttgaaggagaagtagagttatcccaggagataactggagaagaagcatttggagaaaacagcaacaacatagagggcaatgcccatgtcaaataaaggggacaccggcaggggtaggctgggagagcctgcaaaccataatgccggcctactccctgtgaaaggagagagggaaggaaggaagcttggtcagcaagagcctcagactgtactgcagctctgagatggcctcagacagaccagtggggagccactcagtagagactgctcattcaaggagtcctgcatgcggaagaaatggcttgtctcagtcattggctgggtaggagcataatcttggcatgggtagcacacagctgggagctatgagctgtgttctcatgatagccgtaaggcaagagtgcctggtatggtcaaatagcaaaaatgaatcaatgccggccaggtgcagtggctgacacctgtaatcccagcactttgggatgccaaggcgggtggatcatttgaggtcaggagtccgagactagcctgaccaacatggtgaaaccccatctctactaaaaatacaaaaattagtcaggcatgctggtgcatgcctgtaatcccagctactcaggaggctgaggcaggagaatcgcttgaacccaggaggaggaggttgcagtgagccgagattgcgctactgcactccagcctgggcaacagagcgagactccatctcaaacaaacaaacaaaaaaagaatcaatgtggcacaagctgaatgagcaagagggaagcagcaacgtggtcagtggaataacgggttcaaagtcagaccatcgaggctccttggctatgtaaaggctttggcttttcactctaagtggaatacatttactaccagtgacaaacactgagcagaactgatatgatcttacttcttcccccaccctctttctttaaaattatagattcaggaggtagatgtgcttgtttgttccatgggtattacatatgtaatggtggagagtgtaattggcttcaagtgtacccatcacccaaatattgaacattgtaaccgataggtaatttttcaaacctcactcccttcccatcctccctgcttttggagttcccggtgtctattagttccatctttatgtcctgttgagttcccacttatgtgtaagaacatgtgatatttgatcttctgctgatgagttagttcacttaagattatggcctccagttctatccatgttgccgcaaaggacatgattcattcgctttatggttgtggagtagctcttttttttttttttttttttgaaacagggtctcactctgttgcccaggctggagtgcagtggcacaatcttagctcactacaacctccacctcccaggttcaagctattctcgtgcctcagcctcccgagtagctgcgattacaggcaagcaccaccaagcctggctaatttttgtattttcagtagagacagggtttcgccatgttggccaagctgttctccaactcctgacctcaggtgatctgccctcctcagccccctaaagtactgggattacatacatgagccaccatgcccggccgattgcttagtatttcactgtgtctatgtgccacattttgtttatccagttaactgttggtggacacttaggttggttccatgactttgctgttttgaatagtgctgcgataaacatctgagtgcagttactactgttttaagagcaccactctggctaccatgttggaagtaggttgtgaggagaccaaggtacaagcagggggactggttaggcagctactgcagggagccaggtgagagatggagggactcaggcacagtgcgcagtggtagcagaggagggggtgagcagacacttgtggataaatatggaagccggaaccaacaagaaaggctaaaagactgcatatggaatgtaagacagaaatggaggatacatgtgtttccttggtctgccataacaaagtaccacaaactgggtggcctacatgatagaaaattattgtctgacagttctagtggctacaagtcgaaaatcaaggtgtcagcaaggttggtttcttctgacggctactctccttgcttctagtaggctcaggcattcctttgcttgtagccggcattctccctgtgtgttcacaatgtcttctctctctgtttgcctgtctgtgtgtagaattccctttttataaggacatcagtcatattgggattaggcctaccctaatgacctcattttaatatgaccattgttttttgagacagggtctcactctgttgcccaggctgaagcacagtggcacaatcttggctcactgcaaactccacctcccaggttcaagccattcttgtgcctcagcctcccgagtagctgtgattacaggcaagcaccaccatgcccggctagtttttgtatttttagtagaggtggggttttgccacgttggccaagctagtctccaactcctgacgtcaggtgatctgcctcctcagcctcccaaagtgctggggttatgggcatgggccgccatgcccagccggttgcttagtatttcattgtgtctctgtaccacattttgtgaatatgagacccgatctcacattcacaggtactagggggtaggacttcagcatcttcttgcaggatgcaatcctacctgtaacagagaatgtattaaagaattttgcactgaacaactgaaaggatggagttgctgtcaactgagatgtggaaggctgtgagtgttcacaggtttggatatagtccatttgagatatttattagaaaccaagtgggaatgtcaagtaggcaattatacagacacaaattaatgttcaggagacagatcagatctgagctaaagatatgaatttgggagttgtccggatagaaatgaatagtatttaaattcacgacctggagaagatggagctacaaaccaagccctttgatactccagagttaaatcaggggagaaaagaaggaaccgacaaatgtgattcagagtgacggaaagaataagagaaaactcaagggagatataatttgccactattgagagctgagtagagaacaggccctgtgctatgtgacatacacatcatctctaattccagcaacactgcaaagagaatgcacccctcctttgcttagttgagccagctcgagctaagagacagcgtggcgttgtacttagcagcatgagctggaccgcccagcttcaaatccccattttgcctcctccctagctctgaaatatcatgcaaagtactttgcctctctgtgttttggtttcctcaactgtgaaatacaatagtacctacccccataggatcgttaaaaggattagatgaattaaaactcttcttaaaaagaaccaccgttaaagtttcttgaacagaacacagcgcacagcaaacgctacattattgcctgttacataagtaaatgtatgtaaattaagtaagttaaaagtctcacagctcctaagaagcagaaataggatttgaacctaggattttctgcatttgaagcccatcctgtttctagtgtatcacggtgaatgtgactctttccttagcattagcatagattaattaatctaattaggggaatggatcatttggaaaaatgaagagacagttctggaaggctgcattaaggatgttttactaaataagaaatgaagttttgagaggacaagttgtcatataaatgtgaaagcaataaaagagagagagaaccacaagagaggcctagacccctgggtctaagataggggaagactcaccttttgagggcctcttcttcacaaaatcagggcacctggggtgggtattttagggggaactaagaagataaaggactttgcttccctcttgtcttacctgggaccaatctttttcctgtggatgctcaccatcaggggtgaggtgaccatgaagatctgtttaaagtctgtgctgaaagaagtaatcagagagaatcagaataggataacgttcacaagctcttggttgaagaggactgaaagtaagaacaatcagtatcaaagacgatagcaaagtcaaggagagtgactgagagagaggcctttcatgttgattatgaagaggccaagtcattccaagtaaagttgcagtaaagcaaagagaataaaatagttttaacagatctgcaagccagggtgacagaagatgaagtctggaagaataatcatggaaagtggaagtggccagaatgaatcattttaaagtagctgaaagagaaattaaaccaatgaaaacagaatcgtaactcttggggctggaagggtcctgtggcatgagctactggaattgttctctacatggtgggaaccgaggcacagagaaacccaacaacttgcccacattctcacatctggttactggcagaaccaggatgagaagggctcagccataagtgaagcatcgattttgacaggttttcttaaagagcaaaagggggctgggcgtggtggctcatgcctataatcccagcactttgggaggccaaggcaggtgggtcatgaggtcaggagttcgagaccagcctgaccaacatggtgaaacaccatctctactaaaaatacaaaaattagcgaggcatggtggtgcgcgcctgtaatcccagctactcaggaggctaaggcaggagaatcggttgaacctgggaggtggaggttgcagtaagccgagatggtgccacggcactccagcctggcgacagagaaagagtccatctcaaaaaaaaaaaaaagaaaagaaaagaaaaaaaaaaaccagagcaaaagagaatttactgactgatttttctgttcaggaggaaagaaagaatataaagcctatatgggaagttcaggtgggaattgagcaacaaaaggccatctcactatctgaaacttaggaacgtatgaaataaagggccagaaataggcaagggaagtatgaattgtggtctcttgttctgcttaaaagaatataagaagacctttgaggagagccacaatgggtaatgggttacaaaatttaatctttgagattagggacactttgaagtttatggattgcttaagtgaaaaaaaaaaaaagatagttatctgtaaaaggagaaatattccaaatatttgtttttcctaaacttaactattctacatttttgttgaagaagcaaaatatatgctacattaagcctgacatatatatatatatatatatatatatatatatatatatatatatatatatatatatatgacatctttggttgactaccatggtatggactagggaattcagcttgaaatttatggcacttatatagagttttttttcttcgtatttcttatgtttgtattgcagtaatgaagaaatatggaagctgtctggtggccaaatagtatctgtaaattcccatggataaagcctcccgtttatatttcaaagttattaagttcaagtcctgttatagctctacttttattggtttttcccccatcaaggcaattattgattgattaattcttattggctttctaaagtagaaaaaaattatggctgaaataaaatacttcatacagagcaaaaagtaaggtatatataaagtgaaagtctgagcggagaggtgaaaccttgattccagctacccaggtctcttgtgcacgggtgctctgccacagggagaacacttggcttggtgtgggttcaggagggaccagagttgcttgtgtggggaccagtgttgtttgtcaggcttttggccatatgatgatgctcagccccttgtccaatgtagtgtgcaaacaccgtcacaacctcatctcactcagccctataatctgtggaaactgaggctcagagaagtcgagtgacttgctcaacgtcatacagctagacatgacaaccccagattcaaactgaggtggttttctttctttctctacctttatgtttttaagtttgtttgtttgttcgttttagtttttgttttatttctgacccaggccaagtggtaggtgtagccaaggctccgtgaggatggaaggtccactagttataacctgtgagtcacactggatctcaactgggcctagaagcccaggcaggttgaaagcctcttttggaagaagttgccttgactacaaacggaaactgaacccactttgcctgcaggccccagatctgtcttaccagcttcacctcaaaagcagtaacttatttggcttgaaggaccagttctgaccttttcaaacagtggaggaggggaatgccagttccctaatgtcagaggcaatatttttattccacagtgtgggtaaggtgatctctcagacagacagtctcctctggggttcgcaagccttctgagtgcaaaggttatcttcctggtaactcatctctcccacattgtagacttcctcctccagggtcccatatcaccggggaagttgtggtctggaaggggagtccaggcaagggctggaacaaaattacaaatataaaataaatttcatagccaaacatgcttcattaaaatgtctaaattgaactatataaatctgcttttgggggaaggtcaaaaatggctgaattacagcaattccatatattcaacctaatacatgtaccacaatcacaatcagaatgcttattgaagggtgatattggaccaatcaacttactcacattgccttgtaatcttcttttctatttttagtctcaccctgtaagttttcttaagttttgtaatcttaaaactcacagctctttttccatgtatctaatttctaattttcaaatgtaaaatatcaattagtcatttaacaataactagaatacaaatgaaaatgattacatcgaattagatctggtaattcctttactgttatttaagacaacatttggttttgcttctcatcttttgcaaaattctgaaacttacgcctattttttctttttttttatgtttaaaaattggtttactgtaatgaattaaatgtcctgaagagaaatctaatggactaagcattagatgatatttcaagaaacacagaaccacaaggtaaaaatggatggaaatggtatatattttactgtgttaatatgtctagtcatgggcaagaggcggtccaggactccaacacccccatgcgtgccacattaattgtcacctttattcctctcctcctcctgtggttcccaacacttttaatgttctcttccctctcctctgcctgtccaattcttacccatcgagtcccaaatcttttcatgaactattcttttatttctacagctgacgggctgtctcgtcttcctcaaagtctctacctacaatttactcccaatttcttcattaggttaactaacgaatttttgcatgttaatggttccaatctaatccatgcatattttgactctcttacgggctttggggctcctcaagtcctgttaggttcagaggagggacttgaagacttatagaatgaataactattttttaaatgtaacaggtatactagctgtactttaaaaatgtatataagacaaatcaccataaatattcaaatctattgaaactaaaacagaggtattaaaaacaagagattataagtagattacattaatattatatgaggttttctaaattctacatagagaaacaagttttcatcaaaacagagagaaagagaaagtattacatcactttcatttagtcaggtagaagctggaaggggttggactttggtgggatttggggaaaactgataagcaaaataagaatttatcatctaggcatgaaaaaggagtagataaagatagtcccaagtgacaatgaatacgaaaagtggaaaaagtcacaagagactataacaaggataggctttaggaggaaagtaaaggtttagtattattataatgacggttactactccaggcttctgacaagacaatctgtggccagagaagataagatgtgatgagttgatccacaagttggccccgtcattaggtagtgaagtggtgatcagactcctatttaagataacccatagcctggaatcaaatttgaggtggtatacgtgggaagtgaatgtttgcctggggagtgaatcacaccacacaagaccttgaacctgagagagatcaataaatccctgtggtatagagaccaggagggagcaaagctggggtccataataaatatcagtgggagtagaagagaaaacaatgtgaaagaaagacgacggctatcagagaagtaatagcaaaagcagtaagagatgatttcagaggaaggaatttcagcggcgcgattaagcagaatgaaatcaactgagccaaaatgacaaaaagaccacgttgaacaagaacagctaccatgatgttttgcagagaaaggggtcagtgaaaacctttccaaaaaataaaacttgtcttcaataggaaaaaagaaaacaattcagagccttagtatgtatgcctttgggaggcggatgtacagtattgaaaatgaaggtaactttattttaaagaattttaaagaatacctcctttcacaaagaatgattagacacaagctacttccattcagtcagatgctctccctgagagtaacttaggcacttctggagctacattaatctttttcagtccctggagcaccattaagtacaggcagcagtaatttactaaattgcatactcgaagcctgaaagagttaatgcggctccaaaagtgcctaacatttacccagggagtaatttacacactggaagcatctggctgaatatggattcaattgtttactgtactgtgggtttcacagaaaggaggtcacatgctttctcttattgaaaagttctggggaacaatttctttcatttaaaaaatatgcaccaactgccacactttcatccagtattctgtttttataatgctcaaaagaaaagttgttaccagaaataaacttagagtctttgatttaccaaagaaaactattttattttacttttggctttgttacctgaaggttgggggtcgatagggttgaggtgataccaagaaactagcagatttgttaacagtctttatttcctccctggaagaagccattccgtagatttgtacaaatgtttgtattttacctctctgcgtgccagaatacttgaatgcaatactgtttaataaagaaaagaagaataggaagacattcacaagtgaatcaattccaagttattcttagccagaatgcagcagtacgtgtgttcaggaccgctcaagtgtcaacagaagcacctgcgtaggtattaatttctttaaaattccttctgcatgttacatgcccagcaccacagacagtatattagagagaaggagctctcacgtgaaaaatcttgtgacctaagggaagggataccagcaaacaagcgagaacacatagaattccagactttgtggatacactttctagatagctttaaactgccaagataatgacaccctttctcaggatgactgaaatacaaggcttagtatataattgcttacacctctcaagtggttatattcacaatcaacatcttctgtctcagcaacagaaacatgtgatcatgtttgttaatattttattcatttgcttagaaaacctaggcttgctaagtcttacagtttcttagtaatttaggtcaaagttcattttactttttcaaaaggtttattaagtataattaccaatacaagcagaaatgatttttaaatgattttctgttatgcatcaaccatatttccgatgcaatctacttccatttattagaatatatgcactgggaccgattttttttcagacaaaataatgtttattctttacatctacttgggaaaaaagccatacagaaaagtagaacacagatgaattcagttttagtatactgaactcgtctcaaaaatcccaaatctttgtactctatatctgtgcaataaaataatgcagtgttttaaaaacctgatcggatgcctccttgatctctactttttgaaaagagaagtaattttttcactctgatgatcctagtctatatgagtatcagttttggcatggattttaagtgcaattctgccctcttagtgatggaataatgctccccattgctgtactcattcttctacccccacttccctttctgtccccttttttgtctgtgggactcctaaagcttcctggagtctctttaatcctcctcggttctttgcattttcctctgatctcagaacagtcatgcagcacctcttccttcttgacaggccttgggccaccatcctctccctttgactcatcccattgctaacatgttgtatttaatacaaatacaaataaataaatgtatgcaccaaaattattggagcatatattgtatctgcatgtctttttaaccatgaaatccaaagcaatttacagaaaatgtatgcctatgacagcgctgtaaaataagtaagtgcaaaaatagtactattttctattttatggattgtttaaaatttccgggaagaaagaaaaagcgacttccttttttcctctctagaattcttgtgagttgttctagcctgctttgaatcatgcattcagtattatttactcacattgtgtgtgtatatgtgtttcattgtgtgtttgaaaaaaaaagccttttgcaaaggattataaaccttatattatttgcctaaagccaacaggggcagagtagcatgttccaaagcaaagtaatctctagtaaattatagagtaacaatatttggaattactgtgacattaatgtactaagccataaattttaaaagaaataccaaaatctcatcggctttttatggcttgctttttgtctaaaagagtcgtgtgtgtgtgtgtgtgtgtgtgtgtgtgtgtgtgtgtgtgtgtgcctttgaaataaatgcatttgactactaatgtgtacactgctgtatgaaaataaaaaacaattcactagagaagtagggaaaagtcttttaaaccaaagaacagagaaatcaaattatactgggaaagaatgatcattatacaattgctgcactggccaatagtgacggctgctaatgggaagacatcagatacaatctttaagaaaagaaaaatgggcaatgctcattcagtcttatgtgtcctgactcttcacctgaattgtagctcatctctttcagagggatgcatacataaagtatgtattttgctgcttcgaaaaatttcatgagaaaaagaatgtatataattgcatcattttccatggtaatactcataaaagaaaaaaaaaacacattttaaaattccatgtccccagaacatcacatggcccctaaaaacatccccaggctttattgtagcaaatcagctaaggttcccatagagaaaaaaaaaaaatagactaatgtagaaatctcaggacacatattttttatctgcaagaagctgagactgctttactgatatcaggtcattaattatcactaggtaaaataatcctcatctctaaaataggcagagattattctcttggttttgtgaatgaggggaatagatcagagtttaaaagtctcatgaaaaaccacagagccagcagagaatctgatgatatactaagtgctgaatctgtgcactgcccaccattgttttaatttctgcattagctgagcaatgggagtaaacctcactttggataatagatgtgtccccataaatgttagcaaatcgaatttttgtcaagcaaattgtattttaaataaacaatgagcaattcaaagcaacaaaatgtggggttttttccctaacataaacaatccctgtataatgtgaatagcactccatcatgtatctgttttacaagttttgaatatgatttagtggttgtttttaaagcaagtgtagcctataattcagtacttttgtcacggcacttctagttaaggtttcttttctctttcttcacctacctctagttacctgcaccctttttcccctctttcatacatttttatatgcctcaatccagaactgttctggcactgtccaaatatttgacaagacccacttgccaaagtcgaaatccacagattgaatgggctacaaattcacagcatcctattagggctctagttggctgaacgaccaagggtttccgtttctattaactgcctaaagcattcttcaggatggctctgcccacatcttccctttcacctaatctctaccagcctcttatttcaacttcctatcgcactgacaagataaaaccagcagatttccctcacgtttcttcttctgcacaaatactcatttccattcatttctcctccttcctttttctcttgaagatcagtgttctccctgctctcaggggtcaccttttctgtgtgtgttcctgatgccaccccattcagcatttcccaccatttcacctcttctagatcccatttctccagcatgttcagtctcttccaagtgttctggctctgctctgttactgctaacattttcaggagctcttctgttcccaatcccaacctttagtgtttccgcatgataattaagaacatcctcatatccaagtctggtgggggtttgcccttggtatcagtctccatgactcccccttcaatattttctaaacttccactgctcatacctatagcgttgtgggatgttggttctcatctggctccaagcacgtcctcttcccactcttcttaacagcccactctcactccccctgtcatctatgtgtaaaggttccagttcttggtcgaattctcttctccctcagtatgctttcttagagatcatatccagaactacaaaatcctcagaggattaagagtgaacataggaaattatatgcagccattaaatgatgacatagatatacatctataggcacaaaaaggtgtttatttgcataatatttagtggggaaattgagaaaaaatgctataaagaaattctccaaactatgaacagtacttctggagcaatgatgggagaatgggtgtgttttattttcttccaaagtttccacaatgcccatgactcctgaatcagtatctccaattctaatatatcttccttgaagtaagtctcaacagaatttcaaaaccaacccgtcccaaaacaaaactgaccaaactgtgacctgaacctggttcccttcaagtgtttcctgttttatccctgatcccagtctattcttctggccatttcttcatctatcctcttacccaaggtcacagagtttttaagtggcaaagccagaatttgaatctaggctgtctgactccaaatgtcctgctccttccatcatcccaagcccctggcaatcaggaaatatgaacaaagcttcctttgcaattgtgtaagggaatccgataagaagaaaaccaacggagcccctgagagagataaaaggctgtttcccctcttcatcctgcactacacctgactgcagcgctaaacaatctttttctcagtttgatacagattcaaaggaattgggcttcccagtttctctggatgacaatccttttacacagccttgaccattattcacttgatccatttggccacaggttacaactgaaacctgaatcactagaaacccactctctcaatatgcgtagagtgttgtccttcagcttgccatttaaaatgcagaactgcagcagaaatcaccttttggtttcgttatttttctaaatttctgtcagacaacggcataaggaaaatgtcatagctgaagtacacatttctagttccctttagcttcacagtactgaacaaaaaaatagactcagtgctgaacaaaaattatatatacatatagagagagatatcttttctttctggatgagtgacaatattcgagcaaatgtaataagggcagaaggaggacattgagctcacggggtaaggcattaacaaacaaacgtggaagggacagagatgacatcgttggcacaaagcagagaatgctgagctggaggaaagatgaaggggcaagagagaaatggaaacatgggtaggttcgtaattaagtggggtagggggttaaataaggaaatggatttttaaaaaatgagagttgaaagaaattaaaactcccagcccaatttccaaaagaaataggatctgtccctcgcctctcgtcctcatgcccctgatgtctctgcagccttcctatcttatttcatctaccgccttccttcactatcgtatctttttacttcttgaacttcctaatgttccctaattcctttcacttgattttattttgcctgtatcatatttcctgctgtgccatcattatcatagcctagttctctccacatataatatgtcatcttaaatccttccatttttaatcatcaacctctcgtagcaaccccttacctgtcacttttgcagatcctccactgacttgtggttattcgcccatttggggctttaattcagcaacagctccttaaacttcctctgtccttgcctactgccatctacaaaaaccagtgaccaaaagccaggaacacagctgttgtttctattgtcaccactcttcttgtggaagatgatgatgatgatgatagcataataatattacctaatattagttgaatgcagactaggtaccaggtactcttctaagtattttacttgaaattattcacttaaatttcacagtctccttccaaagtggcatcataatgaatcccagtttataaatgaaggaactgagatacaggtatgttaagtaatttgcccaaggtcacctgtctttgctcttattttcatgggtatgattatttagtagatacccaaaaaggggcctgctcttattttttttttcagcgccttctcttgagggactttggacaagtttatcagtactgaattgaagtgccagagacacctctccctgctcaaaacatatcagtatcctgggtcaatgcacattaagagtcttctgatttgagggtgttccttgtccattgccccacgaccccacttagcagttaagacatctttgccttaccctcttttataagcttcttaattctactgtagtagaccttggccttaagacccccaaatatcttatatttgtttattaacttaatgaatatttattgcggaccagtggtgttttaattactatgttgacttgattcaaatatgtacgtggtctccaggagccaagagtgaagtagaccaggggaacagaaggcaggggccctgcataaaggaggacaatttccaggaaaagcaacggtccagaaactcacaaggacagacactagaaaaacaaggagcagctctgtgtcctgaggcacaaagagggatggaagcagggtggggatggtgttgtcatggaagctgtgtttaaaggagagctggctttagctgctggcaaaaaggcatgtcttttcacctaaggataaagagtgaggtagcaagaacagaatatagtaccctaaagactagtttacaaactgctaaaaaaaaatctttagaaattttctttaacatatctgtaaaagtacttaaattaacaattttcaaaaggttgattcccatatcccagtccacttacaacatctccgtttaatcagttttctttcttttcactattcctgacacattgtgtaggattgttgatgtaaaaagattaatgttgagccaaactggctgtctatgcacataaaatgaaagggctacaccatcatctatcagtttatgttaactgttctgatcattagtgattaccaatcgacttggatgcagctattcgtattaactggccaaaatgttccaaatgaatagacctgtcccactaagacctgttttttaatgcttacatctgaaaattcaacctataagtgactggaataattaaagagtaggtaggtcttaattagatatagtgtactacatagttaaatatgtttataagaaatgcagtttctctagtttcaaagaggatgatgcacttgctgaaaccagcctaggtcttatatagcattattgtacatatataaatgatttgttaccaaattatctatattttcagagtctaatcagggctaagctctactgattacacatataaatatctcatttagtacaatgtatagtactaaccagctacgaaaaggaaggttcttttaagcttgtacgtatttcctctataaaagtagatattctattaaaggtactttaaactatgctatttaagcttcatctagcctaatcacatgttataattaaagaagacatataagtattcttggaaatacagccataaaacaagcaaaacaagaaaaatgttgctggaaatgtctcttcttctgaagtaagcaagctcagagtgaccatggataaactacgtgcatacgatttgatacataattcttagaatttgcacctcatcctgagttgtcctcaataaagttatttttttaagtccttgactagcaatccagtgtcctcaatcagacctaatagataagtgccatattctagccactagatttacagaaaccagaaccctgtgactttcagcctgaaaataataactagcatcctactgtccaggtacccaattctatgggagtgatatggagcccctctaaacccacaggggagaattatgtataaagtcccactaagctggcttttccctttgggtgaatgttgtgtagtaataagcggcatgccgaggaggttgtatcaatggatggctgctgctattagaagccaccaacagcctactccatgacgctcacaactaaaggagcctgaaaattactaactaataataatcaacactaatattaaaccccggaactcctaatttagaatgccaagcagacaatttgaaaggagaaagaaaggcaaaatacctgtgtcattcaatagcatcactgataggaaacagattcacaaaatacttactaaggggtgcaagcaaataacaaaaaataatcaaggtgatgattccatgtggtcaaagcacacataaatttagaaaaaaaccaaaaggatattcagcaaattttaacaattatttgttatctgtaggggaggattagaagtatttgggctagcctttcctatatcttctgaaatgctacattaagcgtgaattactttcataaacaggaaacaattttaaagcaaaattagaaaaaaattaaatgaactactcaacaacatatgttttcacttaggaagaaaaaatgctcccctaaagttcaacctcttacaaatgaaaaaaattgagaagatatttcccgttctgtttttcagtttagattgatccttttcctcttctactagcagacagcagcaaaaattgatgaagccagtgttagcgctcaggttcaatatggattcgcactagcttgccttttccatgtcagtgatcatggtgggcagagcagtggaaataagttatgtaaaaggtttccgcctagttgttgttttaattaatctgggtgcctgaatgacacacaggcttaatcgggtggtatggaacctgtcgctgttaagtaattgatttgaacccaaacgcaggttgtgatcaaaagctgtcatcgtccagtggctactcactggcccatgtgaaatgggttggtggtctcagtctaattccttgtggaccagtgtcagcctcatgaaaagcattacctaaagtggcactaattggttgacattctcagcatgaaagagtgaataaagagactgaaaactaaaataaccttcaaagttaggctgaggatgaaaatgggccatgcagcattgaaggggttacctctgtagccagccatgatactgcagtggaaagagaggagtccagttccagagatttcaaccccacccctatttttataggcagtggaagctgaacctaaggaaattaacttttgtagactactaaaaatccttagatttactactcacaatcctgccttgtacttatatgtccctagggaaatctgagcaaagatattttaccaaaaggcaacaggctaaaactgactgctaaacctttaaaaaaattctcaaatggagatctggcttcattattaccaaaccgtgtgtgttcatcactttaattacaggaaaaatcgatagggcatgtaaaagtacatggcatattttacctgacatttgtgcttcttcactttattaagcatgcctttttgaacggaaataacaggctagaatttaccaaaagtctcggtacctgagagcaaagatttctcttgcactcaatttatctcctgtatggtgtctttaccctttcaaacagcatgtttttagtaaatgaacacgaaaacaaattgaaaaagcaataatggatgcgttctctcattagtgcaaccaggcagattactaattcacaaatattgaaactagcactgatggagatgaatgaatttctcataatttaataatgcaaatcacactaacagcagagacctccgataactagtggcactagaagaattactatgaatgccaactgatagatgcaatgttgatagagctatttatcttgttgtttcattggaagtctcctcttttatgatatttattatttattctgtatctctttacattttacatgttataaatgactttctcctgaaaaagacaggaattatggcaacaaattttgcaagttaataattttattttttctcaggtatattttgatccgtgacaaatggggaggcaatggctgtttcaaatgtgcggtaatcacgactagaagcatttttcaaaagttatcatacaaaaaaattgacaacatcactttatcacacaaaaataatgggagaaatgcaaacctgttttttaaaaacaaaaatatccaatgaaatgcctttatacccagaacttcttgacagataaaatgtactatttaaaatatagtttaagtggctctacaattccatacttctaccatgaagcttcattaaagtctataaattagtactactgtcagagatggcattaagtattcaataagagtagacttaatgcaattaatagcaattaaaattatacttttatgatgttagacaccagcattgtaaagacataattgcctgtaaggacttttgtaccgtatttatcctctaaaactgtccaatttatatgaaaaatgccaaaaacatatcccatatgggtacgattatcttctcggatttttagaagtaatctgtcttatccagcatgcgcacaataggctaatttgctttaattagtttttttctcattttgttaataggcatgttgatgttaagtttttatttcagaggtacagatgctaacttcactcattatgttcctattaaagggtcagtatactttgtgataagctggacttacccacttaaaaagcatcattctttgaaatattagatgatatagcttatcaaacataaaaactatattgctgttatagtaatcgtgagcaacttctatctacttatttggtagctaaagaacagcttcgctgtgtctgctgtggcgaggcatttttgtatggacataataaattagagaaactaatgaactggtttcagaaacacagtcatttgtgactcctcaaagcattcataagaattaccatgaatctatgccagtgctttgcatttaagccgggaggcatacaaaataaaaaatgcttttctttcccatacccaaccatgtcctatgcctcaaactttaaagacattttattaaagctgatgcattaaaataattttattaattattatcccctaccttatctgtacaattttctcaccctgaactcctataaagaaaaataattatatatatatgcaaagagcaagacatatacttaagaatgctgcccgttggttctctggagacagaatttttaattttttaaaataagtaattgagaagattctgcagaatccccagatgaaacttagaagacttaggggaaatattaagagtgagtttgctttccctctccatttgataaatatatttagctccaagtttgtatacatgtctttacatcatgaaatatattcattacattcatacaatgattttctcagcttacttttcaatgttcactatatttgtgaaactgtgaaaaaccacgtaatttcacaattgtaaagttgtaatgaaatcataggattgatttaaaatctgaaaacattatatgttttgaagtgcattgttttacaataagcaataaaacaattatcaggttggttcaagttagtatcttttgggaaacttcctatatagataattcaaattggggtggggtagggggtagttaagggagtaaaaaatcaaatcattcagatgcctttgaataggatggagatacaataaggatgtcttaaaatacgtcattgttttaaataagtaatctgttatacatattttattctcaacatgtctgtctgtcagtaaaaagacatactcgctgggtagttttacagaatagttcagtggcttcccgaaatatcagcttctattgttttgttttcttttactttgtcttttgttgtttgttggtttttttgttttttgtgggtttttttttttttttgtgaactcaatttgtactctttaaggcttgaattgttttcttcaggcagccaatagttgtattgataaaatctataaactgaacattttcatgtaactaaaagaaatcattaaaaaatcaacaaaattgaaagaagcaaaaactcaattgcatgattcatcctttttaactgttagtctccaagattaaagcagctttcatgagcaagaatgtttagctaacgaaaaacagagtaaataacaaaaagtagaataaattagaatgtaattgtccttcacaacctatcacataaggctttcagatacaatttgaatataacaatttcttctgtatttcttttgtctccgttgtattataaagcagagcgattacgattcattggaattgaactacacttatttatatttagtttcttgtttctaagaaaagtagaatgaggctgggtgcagtggctcatgcctgtaatcccagcactttgagaagctgaggcgggtagatcacttgaggtcaggagttcgagactagcctagccaacacggtgaaaccctgtctctactaaaagtacagaaaattagctgggcattatggtgttcacctgtaatcccagctacttgggaggctgaggcaggagaatggcttgaacccggggggcggaggttgcagtgagctaagatcgcaccactgcactccagcctgggtgacagagggaggctctgtctcaaacaaaaaaaaaaagaaagaaaaaaagaaacaatacagtgaattacatctgcctttgtcccatttgtacagtgaacatacactctaagtcaattgttcaataacaatggggtgagtgctggaaaaatagaactgtgggaaaatgtgtatgtgaaagcagcttattcacaaaatggaagcacaaatatttttcattacaagtaactctcaaatggcaatcaggttgtattgcaaaaggcatttacatgggagttggttgtttaggtatataatttcccgaagaaattatgttaaatggttgtcctaagcttaattaaccacaaatataattgaattcaaaaacaatcatctgtatttgtgtggcgcccatatatgtgtgtgtaagttattttaaaattgagtacttgctatagattagcttctgcgttcagtattttatgcctacttataatcctatgagacagataccataattagatccactttgtagatgatgaaatagtcatctatttcaggatccaaaaccagatccttcatctttaactcagatgtggcccagatttcaaaataagtaagatttataagagaaagctgccacctcttttcacaggtcccagatgtctcactcaggagactaagacagtgattcccacagtgacacctcactagcagccctttccttcctccctcaagagccccagactctaaaataggctcccctcctcctcaggcaaactcaataacccagagaagatgatggtggatgagtgttaagaggaaagcattggaatggtggttggccttgaccgctattgatcaagcacctaggatagtccaacttctactagagaaaccagggtcgctacggttaaaaaaaaaaaaaaaaaattaccttcaagcttaccttctcctgggggaggaaagacaagcacagaaacacaaaagtggacagccgtccaagctgtgcagacagtgaaggatgaagtggctggtgggggcagagacagtacagaaggggacagctttagccaggagagttcaggaaacctctggagcagatggctgtgagcaggaatggatgatggacagccatgctgagacccaggaggaacgcttacaagctgaaaacatcaagcacaaggactctgagagcccagggagcctagcagttttaggaaacaaaaagaatgccaggacagctgaagcagagagtgaaagggggaacatagagagaaccaggaaccagggagaggagcactggttgccaggggagcacttttagggaagaggtgctgacttgatttgatttccttttttcccatcattctgtcaggtgagtggagaatgcactgcagggacaccgtttagaaggtgataaaagagttaagctgagacaactgtggcttggatcaaggttattccagcagcacttaagtgctctgatttgggtgtattttggagacaaagaaatcacgatcagcagaacttgaagatgtactggatacgggaacaagggtggccactatgttcgaggtctaagaaactggatcaatggtagtgggattgactgagaaaggagactgtctgggaagcagctggtctggactgactcttctgaggagcggattataatggggcaacacacaatgaatgaatgactgatggtcttcctaagcctcctgtgcaaccagtaagctttgatgcaaagaaatcatcatttaatgcaattttaacccttgcaatagtgaagtaaaagttttagggctcggctgtctacagattttgtggagaggcagaagacaaccttagagatgagtcacacttactatgcacatcagccatattctacttttcaggtttgtttcacttattccacttcagacatcatggactttctaacatctctagttgattcgtaaatagttggttttattggtgtcaagcccagcaaagatgatagtggccattttatcttgatgggttatttttgtaattcggtcctcagtacgtaagcctgaggctgcctgcgcacgtgtgatacctttcaacggagaagaaaaacatggaccacctaaatgaggtgggcgagtatgtacatacatgtacttattcaatgttcccgaagtgctgtcaagaggaaggtttctatttaatatcatgagatcatattggcctcatgttctcccaagaggaacacagatgcctagttgtgtggctctctgttaaagatctattgcatttcatgaaaggcccgatcaaaacaccaggcaggagggaaactgaattgatgcatttttgccaaaaacatggtagtaaagagtaaagtcagtgactgatagaatgtgtcgctgagataatccacaggctgaaggtgcattgctgggaatttcaggacaagctgtggtgatagattatgtgatgcaatgtacatcgtcagctctatgttcctcagtttgctgatctgtaaaatggagacaataacactcaccctcttccacagagatttaagactaactaataaaaaaggtctatgttactttcaagtgcacaaaaaaggattaagccaaacttcctttattgcggcaagaacaggatttataatcttattcaaacaattagatttatttactctgctttgtcttttaattgaaaagttatataagatttcacaatctaatcaggacaaaaagattcttctagattcttatagttaaaggaattggtagccaaaaaagagacaacttgtttgcacaacagttctgtgtgcgatattgctgtttgccactaacatgcttttaatcgctggtgacttgtgagatataatgagttttcttttctcatgaacatctgatgagggtcatggtcatttccaaatttatgaccctttttaaaatcatgcacagaatccaaattttgtattagctgatgactgcctactgatccatgtgttaattgagtgtgatttgttctctactggtaatgactttgccaacctaagagggaccatgcccacaaggagtatttagtgaacatcacctacagaggccaacgctgaaacaagtgaaagaataaataaggaagctccaaaagctgagcaattaggctttgttctctcctgtacctaaacccgtcttttactccgagatgtcctaagagaaagacattgtttcccccgtaccctagccaggtatcaagaccaaacagtacccaaatagcctaactgagctgcctgtgctgcctttctacaatttatggcatgcaattagctgtctggttccctaatgagtaattcctcaattgcagaggttctaggggactacttaattcagccctgccaacacaaccccaccctagatgttgagaccaatttctccaaatgacctcagcagaaaagctcaaacctctccagccattaaatcatcattaacccattcctgttagaacttcccaccctagttccaataactgtatgttttccttccttattatgacaaagccttgggccccctagaggtatcctgaagcaggataacatactacttggaatataggcattttatcagactgccctggtcaaattcccagctccaacaattattagttctgtgagctgaggcaagacatttaacctctctgaactccggttttttcagatgtaaaatggtcaaaataaaacatcattcactcctggaacaattggaaatactacatgtaaagcagctagcagagctcttggctggtggttgagtgctagtcgctattctggtttctgaggacttgattttgatttcctgagtccttccctttaattccagattttgagcccctgtcacaattgccagattttcctggcaccagcaaccttgtctctcatccttctgttacaggatatgcttgatttcatttactgctccatatttctcttctactaaaaagagactttgtgaatgatgacaggagtgtgaaaagaaaaagtcaggacttaaagaccaggcaggtgctccagagagtggcaagttgtcctgtaatgttcaataagtagatggtgcaaagaaaccaggacacacaggcaaagttctgagactggcctaaggtattgcctgtcccgacacatttttaccacccatttcttggaagttgcaggacagcctactttgccattgacaatttagttgacttcatagggatgaggaagaatattatgtgtatacaaaacttgtgaagcaatgagaatacagtgcttccgtggaataaagttagtgtcataacattcctgaaaaaatatgagtttatattatctgcatctacaagtgacaacatggcatgagctaccaaatgtcatccaacacatcagacataaaatgaaggggaagacctccaggattcttcaatattaaaatggcctatatcacttttcaaaatacagcccatccataagtttcattcgcaacaaaatctaatgaagatgttttgttattatggaaatgtgactagaacattgctgtattcaggatttgacatatcgagaattcattttcaacctcaaactaggtcctccaattttgatataagttcattatggaaaagagcagcaattcattaactcctagaaactttatgcttattaagtatttaatgagtttaacctttatgttaaatataaaataataagaaactccataccttccaaacctgtgaaaattttcatccatagttattttaatccatttgatgaaaattatcaatagacttcagagattttaatttggtgaaaatttagtctacattctagcgctggattttctacgtcatatcaactggttttattgtttctttttcactgtagtcaattagatgggattatttcatttccaaagactgcttttactcagactgtgtagctgttcagtgaaatataatccaactcagccctttctgcatccaataaaatcgtcagtcagtgttgggggagcaatcattgaaatgatgaaatagcagtattgctgaaaataagcaatggaaaattctgcaaaagctaaaattataccaccgggacctccttgatcaccacagcccttctctagccaagaatcggttctcccaaagcattgagaacctgtcctttgaaaggaaaccattctcaagcaggaaaagcactttccaggggagtattcgcctagatgtgactgcgtctgatatttataggatggtctctacttatcccttgcaagcatttcgtcttgctttcaggtgatattgctgtcagagatatttgcttcaattgattatttattatgaacccacaatatccaggtaccaatccatggttggtcaagggccacccttaaaatgtttaaaccagtacaaatataggcattaaaataaatacataagaaacaatgtattttgagactctaaaatatttcttgcttcatctaagaaaacaggagtctacaatttgggaaaaatgaaggtttacatttgccgaattagagaagtcagcgatgttaggctttgttagaactatctgttaagtccagaaagaagactattatcttaagttgattagggagaataagttgagcggtggctgattatataataagaaagtctaaaataataattttgaacatgaaagttgaaaagagcaatctcaggaatgttttgaagaattaaagccctggccgaagcagagaaaggcagttttctttccttttttttttttttttttaataattcacggaacagaacaaaccagaaaatcttatttgttctaaagcttcaaaactaccttcaccaccaccacccaccaaggtatttgtattcaaatccctatctaaagtgtctcactttcatcctgttatataacctgtttgcggtcaaccagttcagcattaggtagttcaaatataaaatattttctctagcttaatgggtcttggtgtttttcaatataaaaaaaactctacaaaattggctgcacatcgaagaaacaaaataacatagttagcaaatgtgggtggtctttcgaaattctcatttgtcttggcataaaaagaagtggtctctgttccttgctctctatctatgcataaatgctgaatgtgggtgcatttctctgggcttcagtttttctgtttattaaatggaacctgcctccacttgaaagtggtatatcacactgttactgttcggtaactaaccaaacaacataagaaaccaaaatttccttgtgaagggtgtttcttttagaagctataatgactctttcagaccaatatggtaccacttagtaaattatagcttccatcaactactacttttgctgcatagttgttctgaaaaaaaatatataatcacactggcaggtacttgaggagcgacttgtgcacttagagaatgcagatgtgtatctctaaagtgcattgagttcttttcaagaatgttggcacatatatttagacttgttaaaaattcagagataagcaacacataaaaagagaaaaatggccttttttctaagactatttaggtggattttattctatatgagagacctaaggtatttctaaaatgaagaaaggaaaaagtgagatcaagttgattggttcaacaattggtactttataaattccatagatcattcagcataggaacttgtatgaagtttataatactataaccatcacataccaataaagaagctttttgaaaaggctttaaatgtcattaatgttttcccaaatttcaattgaacttgttgccttggttttcgacttattgaggagaaaagttaatcatattctcttttgtattataggagaaatatataaatgccttgaaagcaacctcaatcccatttatattagatctctgccagaaggaaactctttcaaaaatagacagaagtttttctccaagacagaaagcatgtttacttgaactcatttattggtctttcactagcacctgggatgcccatgaaacaagtcagagttgatgaagaccaggggctcagataatcacaggggagagagagagagagaaagagcttctccctttaggtgattgtcagtaaaagtccttgtggctccttgcaccttccccatttcctcatttccccagttgaattaaatctaacctttcctcagactcttcattaagtctaggcttaggctggaggaacgaagaggctcactttagtcaagaactccacattctcggttggttctcctgtgatggtaatactgcctttcactagtagttaggtcctgcttccgtccaataagaccaggttcctacctgttaatctgattccatgattccaaacttaactttgtgtctgctattgaatcccagtatccctgatgaacttcttaaaatcaacaaactcccaagtggacctcaaaaaactgttactcctgcccttatttaagaatactaataataaaacattgaggcaaagctttttgctattcatacctgtaggctatagaccacccattctttctgaaagaagacctgcattcacatccatacttctgcatcatatttttcccttaagcaaccaacacatacctttaccttatgtcctaaaacacggcctttatacgaaagctcaaatcggccttgactcttgactttgaatttttttgtgtagtagacctttatgccaactaacttgtatataactgtcaccagatcaactgacgtattatgcttgttcaagtgagatatattgatcatttttttaattggatggccactagtgacttgaataatgggtatttctggaaatacaaatagtagatgcacagcatgcaggtaagttaagtatcagctttacctaggaatcagcgggtattcttgatgactaagtacccacatttactttcttgtagttcagcatctctctaattacaattatattttatgtccatcttctcagaattcttggaaaacaacactgtatataaattagtataagcaggtgggctactaacattttcttgcagtttaaaatactgtgatcgaagtgtgcaaccagtgtttctttccaaatgacctgaagtcagctgacccaatacaaaggtttggaaataaaattagacttaatatattataccccatgggtaaccagcttgaaactaagtaaacatatatacatattagtcattttgacaaaatacctcataattaattataagaatatatttaaaactaagtaaaatttggacaacattgtagcttctcccgtaatgatttgatttttttgcaagcagatgcttgactgttacatgcaaaacggacatgatattgactttgttttcttgttatttacacattgtgagcttcaggttgtcaacattgtgacactgacaagggaaattatatctcactaatgtttaccagtcactacacatgtcaaagacttcaactttttataaagcaaggattagatttaccagcctacactcttttcttgctatatgcaattcttttaaaataacttttagtcttatagttctttgaatttgaaaaatatttccctgtgtgtaagtttcatgttccaataaatattgtcaatatatcatataattttatttagctaattcattcatgaatgctaaaaaaaaaaataaatcttcaggcctttcaagacttaacttgttttcttattctcactctcttaatgccaatggggaaaaacattcatttttgtaagtaaagagatatgaagaatattggatgtgtaaccatattgtagttggcttatgttaaaagtatttttttctttatttcttctaaaaaaacaaaacaaaacaaaacaggatatatgtacagaacgtgcaggcttattacataggtatacatgtgccatggtggtttgctgcacctattgacacgttctttaatttccctcgcctcacccccaaccccccaacaagccctggtgtgtgttgttcccctttatgtgaccatgtgttctcaatgttcaactcccacttatgagtgaaaacatgcggtgtttggttttctgttcctatgttagtttgctgaggatgatggcttccagcttcatccatgttcctgcaaaggacatgatctcattccttttcatggctgcatagtattacatggtgtatactatgggtgtaccacattttctttatctagcctatcattgataggcatttgggttggttccatgtctttgctattgcaaatagtgctataataaacatacgtgtgcatgtgtctttatagtaggatgatttatattcctttgggtatatacccagtaaggggattgctaggtcaaatggtatttctggttctaaatccttgaggaatcgccatactgccttccacaatggttgaactaatttacatccccaccaacagtgtaaaagcattcctatttcttcacagcctcaccagcatctattatttcctgactttttaataatcaccattctgactggcgtgagatggtatctcattgtggttttgatttgcacttctctgatgatcagtgatgttgagtttttctcatgtttgttgaccatgtaaatgtcttcttttgagaagtgtctcttcatatcctttacccccttcttgatggggttgttttcttcttgtaaatatgtttacgttccttgtaaattctggttattagacctttgtcagacgggtagattgcaaaaattttctcccattctgtaggttgcctattcactctgatgacagattcttttgctgtgctgaagctctttagtttaattaaatcccatttgctaattttggcttttgttgcaattgcttttggcatttttgtcatgaagtctttgcccatgcctatgtcctgaatggtattgcctaggttttcttctaggatatttatggttttgggttttacatttaagtctttaattcagcttgtgttaatttttgtataagatgtaaggaaggggtccggtttcagttttctgcataggggtagccagttttcccagcaccatttactgaatgggagatcctttctccattgcttgtttttgtcaggtttgtcaaagatcagatggttgtagatgtgtggtgttatttctgaggtctctgttctgctcctttcatctatatgtctgttttggtaccagtaccatactgttttggctactgtagacttgtagtatagtttgaagtcaggtagcgtgatgtctccagcttttctctttttgcttaggattgtcttggctatacaggttcttctttgattccatatgaaatttaaaatagttttttctaattctgtgaagaatgtcaatggtagtttgatgggaatagcattgaatctataaattacttcgggcagtatggccattttcatgatattgattcttcctatccctgaggatggaatgtttttccatatatttgtttcctctctgacttccttgagcagtggtttgtagttctccttgaagaggtccctcacatcccttgttacctgtattcctaggtgttttactctctttgtagtaaatgtgaatgggagttcattcctgatttggctctctgcttgcctattggtggtgtaaaggaatgcttctgatttctgcacattgattttgtatccggagactttgctgaagttgcttatcagttcaagtttttgggctgagacaatggggttttctaaacataaaatcatgtagcctgccagcagagacaacttgacttcctcttttcctatttgaatatcctttatttcttctcttgcctgattgccctggccagtacttccaagactatgttgagtaggagtggtgacagagggcatccttgtcttgtaccggttttcaaagggaatgcttccagctttttcccattcaatataatattggctgtgagtttgtcataaatagcttttattattttaagatatgtcccaccaataactgtttattgactccctccttttcagttttttggaacagtttcacaagaagtggtaccagctcctttttgtattttctggtggaattcagctgtgaatctgtctggtcctgggcttttttggttggtaggtgattaattacggcctcagtttcagagcttgttattggcctcttcagagattcaccttcttgcaggcttagtcttggtaggttgtatgcatccaagaatttatacatttcttctagattttctagtttctttgcctagaggtgtttttagtattctctgatggtagtttgtatttctgtggcatcagtggtgatatcccctttatcatttcttattatgtctatttgattcttctctcttttcttctttattagtctagctagcaagctacatgttttgttaattttttcaaaaaaaaacagctcctggatgcattgattttttgaaggtttttttcgtgtttctatctctttcaattcttctttgatcttagttatcgtatcttctgctagcttttggattagtttactcttgcctctctggctcttttaattgtgatgttacagtgtcaatttgagattcttctagctttcttctgtgggcatttagtactataagtttctgtcttaatactgctttagctgtgtcccagagattctagtacgttgtctctttgttctcattggtttcaaagaacttcttgatgtctgccttaatttcatcatttacccaggagtcattcaggagcaggttgttcaatttccatgaaattgtgtggttttgagtgagtttcttaatcctgagttctaatttgattgcactgtggtttgggagactctttgttatgatttcagttcttctgcatttactgaggagtgtttactttcaattatgtggttgattttagaataagtgccatatgacactgagaagaatgtatattctgttgatttggggtagagagttctgtagacgtctactaggtccacttgatacagagctaagttcaagtcctgaatatccttgttaattttttgtctcgctgatctaatactgacagtggggtgttaaagtctcccactattattatgtgggagtctaagtctctttgtaggtctctaagaacctgttttatgaatctgggtgctcctgtattgggtgcatatatatttaggatagttagctcttcttgtttcattgatccctttaccattacataatgtctttctttgtcttttttgatctttgttggtttaaagtctgttttttcagggactaggattgcaacccctgctttattttgttttccatttgcttggtaaattttcctccatccctttatgttgagcctatgtgtgtctttgcatgtaagaggggtctcctagatacagcgcaccaatgggtcttgacatcttatccaatttgccagtctgtgtcttttaattggggcatttagcccatttacatttaaggttagtattgttatttgtgaatttgatcctgtcatcgtgacgctatttggttattttgcacactagttgatacagtttctttgtagtgtcattggtctttatattttggtgtgtttttgcagtggctgctactggtttttcctttccatatttaatgcttctttcaggagctcttgcaggccagacctggtggtaacaaaatcccccagcatttgcctgtctggagaggttttatttctcctttgcttatgaagcttagtttggctggatatgaaattctgggttaaaaattcttttctttaagaatgttgaatattggcccccaatctcttctggcttgtagagtttctgctgagaggtctgctgttagtctgatgggcttccctttgtaagtgacctggcctttctctctggctgcccttaacagtttttccttcatttcaaccttggagaatttgatgattatgtgtcttggggttgatcttctcgtggagtatcttaatggagtcctctgttttcctgaatttgcaaaatttcctgaattttcctgtcttgctaggctggcgaagttctcctggataatatcctatagtgtgtttttccagcttgtttccattctccccatctccttctggtactccaatcaatcgtaggttcgatctttttatgaagtcccatatttcttggaggctttgctcattccttgtctttcttttttctctattcttgtctgcatgtcttatttcaggaagctggtcttcaaactctgatatcctttcttctgcttggtctattcgactgttgatacttgtgtatgcttcctgaaattctcgtgctatgtttttcagctccatcaagttgtttatgttcctctcattctagctagccattcctctgaccttttatcaaggttcttagcttctttgtattgggttgaacatgctcctttaactcatcatagttttttattacccatcttctgaagcctacttctgtcaatttgtccatctgatcctccagttctgcgcccttgatggagagatgttgcgatcatttggaggagaaggggcactctggccttttgggttttcagcattttttcattaattctttctcatctttgtgagtttgtctagtttcggcctttgaggctgctgacccttggatggtgtttttgtggggactttttgtttttgttgttgatgatgctattgttactgctttctgcttgtttgtttttctttcaatagtcaggtccctcttctttagggctgctgcagtttgctgggggttcacttcaggccctatccatctgatttgctcctgtgcctggagatgtcactcaaggaggctggagagtagcaaagatgggtatctcctccttcttctgggacctctgacctcaaggggcaccaacctgatgccagtaggattgctcctgtatagggtgtctgacaacccctgttggagggtctcatccagttgggtggcatggggagcaggacctgtttaatgaagcactttgtcccttggtggagacagtgtgtttcgctggagggaaacccacttatcaaggctgcccagattcctcagaactaccaggaggctctcctggtatgcagagactgctgccacccctccccctagggcctcaggtcctgggacatccgaattctgtccctgagcctctggctggagttattggagagcctgcagataagccccacccactgaggaaggatgggtcagggttagacctgaagatgcactctggccacagactgccacagcccgtgcgttgggctgtggggacaagtcttgggaccaagctgtccagcctccctggctccagcaggggaaaagcgcagcctggagctatagaaatgggtgctgcccttcccctgcccaaggagcttaggtgtttggagtcccagtgctggctactgccccctcctccaaggagcttaaatggcttagaccccaggcagccacagctggtgctggttgcccctccccctgggagttcggttggcttaaccagattccagctgagaggctgtaaaaatctgcacattctggggttgggatgctaggccccggtggcctgggttcgcgagtaggatcttcctatccgtggattacacagttccgtggaaaaagcagtttccccagctgcgtagagtgcccactcaccgcctcccttggctggggggagggggttcccctttcccatgtggctctcaggtgggccaccacaccacactgctcttccttctctccgtgggtcccgccagctttctagtcagttctgatgagtgaacctggatactttggttgccagtgaaatattcacacacttattatggcttttttccatgagagcctcctaatgctgttgcttctagtcggccatcttggccccgccccccaaaaatattttagtcttgataaaatacagctatttatacaagtataatgaagcattactttgttcttctcttcagtttaggactagtaaattgaattttattctgaaaaagaaaacagtcacattaagcttaacaggccatctgcatgcatacatatatacatttgtacatacaagtctctacatgaaaacatattaaaaactgacaattggaaacagatatgtgattcagagaaactgtcagaatacatttgaataatattttttattttcatatatattacatatataattatacatattccaatatatacagaaatttgatttacaaataaataattataatagatgtgctataaaaagtgctgtgagttaaaataactctgatttttcaaagaaaaaatgggattcgtatggattatgttcctgagtaaagtcctgacatccaattctattttgaaatgttctctcccttattttctgatacctttagtggaataaataatattgtgttttatacagcaaggtattatgctttataaaattaatacctttttataattcctattttatttttagtgaaaaatattagaaggttaaaaacaaaaataaaaccttaaaagtttccttagcaaggtcctatatgtcatgctaagaagttgagtcttcatcacagaagtcattaaatccaaggaacaagtttagagttcatgtgaactgttagatgcattctatgccatcagcagttacctggctccaccactctttctctgggcttctgtgacatcattctcttcaatttccctctagcttctcagttgcatcttctccagctgctttgcagaaactatcctctgtattcagtcaacatgctagattaaatgtctacagtctcccaagaaaattccatccatgccagtggctacagttactaactatacttggatgactctcaaatgcgtatctccagccctgaccttttcttggaagtccagctccatgtattctactgcacacttgaaagtgtccactcatatttctctaaagcccaaaactgaactcattatatttctacttcaaaccctgatgcccctccaattttccctaccttactgatggacaccatcatactcacagttgcacatcccagacattgagagtcattctttacacccctgtctctttcatttcccatatccagatccacttgattttacttcctatttatttcttatattcattcatttctccctgtatctcaccacaactctgatcaccaaaatttcctaactggattccccacatccaattttgcttcactccagtccatcatctgagctgtagcaaattatagtctgatactcccatgcctacacttcttgatgactctccatgtgctttagaaaaaaggccaagattcttaatgtagcatacaatagtctgtagaatccaatccctgcccacctcggcagcttcatttcaagctaattttccactggctcctgccttccaattactgctgcattgcattttccaaaaagggtcgaatactatttccaaacccatgctctttcagaatctggctaccctccatcaagaggtggagtctattcagctttcctttgagcctgggcaggatcatgactgctgcaaacaatagattaaggcagaggtgatgctgcgtgactttcaaggataggtcatatttaaaaatatatagattcccctctagccccttgtttgcggacacctatttggagaaataaaccagtgtgttatggggaatcacagactaagcccattcaaagagacttcatggagagacctagatagagaagaactgaggcccccaaccgacagccggcatcaactgcaaacatatgaatgacaaggtttcagattatttcagtccccagccttcatgtcagccaattaaggccccagagatcacagaacagagacaagcaatctccactgtgtcctgtctgaattattggcccttaaactctgtgagcataacaaatggttattttgcaccatcaagtcatgaggtgatttgtgatcatcattagatagttagaacaatcgccctggcctttctagtccagaactcacagaatattgcctcctgctttagcacttttcctctcctgggcttccatacacaaatcttcactaattccaggcagtacttaatatttccttatccttctgaaatcagctcaaatttcagcaaatagcaatataattatggaatgtaggaatattacattactagaagaccacgcattctgaaccaaagggatggacgtaaagaacgccggaattgtctgacctgccatggataccaggcatggcctcaaagcatcctagaagctaaagctttcactaaagtctggagaaacaagagagaaagaaactcacattttatggaccataccctgcaacatgtggtggataacactttttggatcattttaaagttttctttagcaatttcttacctcctgagaaacattcttgctcccttcgggtcaatgtcagaataaccacaaccaaaactgctgcagctctgggtctctcaccatagtctggggtggattgtcacaaggatcatgaaatttggaggaacttcattagatgaagggaatattgggaataactgtaaggaaatacagaagcacttcagtaatgtttttcatgacaggcctaaaaatatctgttttatttgaatcttttctttttgtaaattttcctgtagcaagcatccatctttttttttagagcccgtttcaccttgcactttcatggtattttagtcacctcagcctctcaaaacaaaacaaaacaaaacaaaaacaaaaacaaaaacgaaaaacccctgccatcaatttacttgtccattatatcacaattctccacttttccccttgaatgaatggcgagcattcaaagaaacaaatgggtgtgtttaattccgaaactgcatcccaagtcttccaatctcagtcttgagcccaagactttggcttataccaggctgctgctgccactgaaatgaagttttggagttttttcctgtgtttttcaaaataatgtgtaaggattaaatttatgactacactaacactggcgtgtttttcctagcagatgcagtaaagcttagaacaatcaaataagtgtccttttccaaatgagtttccttgggaggcccttgccttatgaatttatgttacctttgttcaatgcacattgcaactgccatcagagaagagcttccagtgacagaagaatatcagtaccattactttagaaccactgaacacttgtcctgattccaaaatgtttttctttcctacacttgtcccttgttccctgagcaccgcttactaatccaggcctccctttctcctctgatggtaaagtcaacaaatcaaggacttctagggaccagcctggaactgaaagaaactcctctgggaagaaaagctctggggctcagagagggtctgtgggatcagcttctccaagtgacatggatgtgattcatggaacactctgaagctgaccagtagaagtcaaattttgtctacatttatattttcatttgaatgaaggacataatctttctctgtgagtaaagtactctctatataatatatagagaactatagaactataattattatgtatagaatgctttatgtgctatatgtaatacttatatattataaagtactacagtataatactttatattatatatacatatatctgtgtgtgtatatacgtatatacacacatatatacgtatatatacgtgtatatacgtatatacacatatatacgtatatatacgtgtatatacgtatatacacatatatacgtatatatacgtgtatatacgtatatacacatatatacgtatatatacgtgtatatacgtatatacacatatatacgtatatatacatatacacacacatatatacttatatatatacatatatatacatatatatatgtgtgtgtatatatatatataaagtgttaaaactgttggtaccctgaaattagtaaaattgtgagctaacgtgctaacacactggggagctacttaccattagccttagctctattaaatagagcaaggttagcctatatatggtgcccattcctctacctatggtgacgtcactaatcaatcacaaaactctttcccaaaacacctagactagacttcggaatccacgccatagccatctcagtcaatcaaagctggctcaaaaaatgaaatttatttgccatttcagaaatagaagtgagcgcatttcctctagaatgtattattaaaattcagattttatgaggaaaagaagatcctaggagaaaaacaaaaaacccagaggcaatggtagggcccctcctatgagtctgtctcagcggcacattagatttattaaattagctaattgtcgtgttggaaggcacaggcgagctgatcctgaggtgagaagcaaaacaaataggttgcagcagtatggatggggcactggggaagcgtttagcctcactaaaccttaggaagctggtcctaatgaggtgtaccaggggcggcagagtctttgcagaaggctctgagcacaggagagcatgccctgggaccaaggacccatctagaaaggatcaacatttccaaccgacatgcagagagattagcaaaatgtttaactaatgctgaagttcaccaagcccaacaagccaatccctgttacatttgctataaaagcaaagtctggaattagagaaaatattcttgcaaataatcaaaatgagatttctaattttaaattaagggacacaaggcctctaataacacatttacatatgcatttcctttatagagtatatcctattttcaaaagtgaatttaagggaagaattcccctgctctacttcttctttctactttgtcaatacaaggggtgttcgcggccatcgtcacagcctgagcggatggcaggatctgcctcgggtactcctgtgcgagctcagggctcctctgggaccaccaccagctgcctgccctgctcccacaaaggccgtttagttgtcaacaataactgaggattcaactatgtctcacggcagccaggtggtcatacagctcctccaatcgccttttgtcttgttcgaatgttaatatcagagatggaggaaagaaaggtcgcatttaaaaatagcattctgaacatcttagcttttctctgtttggacttcttactggatttcctaaaatggcagctatcactgagcacagtcgtttcctttgcaggtgtccaaaaacccccgtcatttcattgttttacattttttaattcatgattttaatttttatttatttatttatttatttatttttagacagggtctcactctgtcgcccaggctggagtgcagtggtgcgatcttggctcactgcaacctccgcctcctgggttcaagtgattctcctgcctcagcctcctgagtagctgggactacgggcatgcaccaccacacccagctagtttttgtatttttagtagagatggggtttcaccatgttggccaggctggtctcgaactcctgacctcgtgatccacctgtctcggctgggattacaggcgtgagccactgcgcctggcctgattttaagtttttaagatgaccctcctcatcgtactttgtctctagtatgttagagaaaaccatcattaacttaaaaacacagggattgttctttaaaagtctattaacataaacctagatatcattaagcttgtatcaatgaagtttcataaatccgtcttgactgattattttgggaatctgatgtcattttcagccacttaaaatgcctgagcggttaaagatttgtctctgatgactcaacttaatgtgggtgtgttgggttttttcctggttgagagacagttctccttcaacgtgttattcgtgcagatgactgagatggtgtctggaaatgtgctctatcacacgaaacattgttaataccatgctcctatttgaatttctcaaaatgttggtgctaccgttgaggtacttgagatgatctcattcaccatttcacaaacagtaaaactttttacccaattgacaaaaatatgcttaattctaaactctctcacaggaacacagtattgctttcatcttcttgttagcatggcaagtctttgtttttagttattttcctgagatggtatttgttaaggcaggttttgcaactgctttgaacctaccgtccccagtgatgtctcctgcttagggtccttgagactggtctgtgtgcattttccccttggcttcagcaggacttttgagagcagacaaattagaggattgagttgtaaatagaaggtctgataagatccaccagccaagtttatgtctcacattctctataggcaacttttacttgcttgccagagcattggaaataggtgattgggtccaaaatatacccatcatatctttaaataatagcatcataaactaataacgattcctttaccaatgaacataggccattaacatataaagatgctttattctttttaaaaaattacctcgaagtttgttattagtattcactttagattgtctttccagaattgattggttttatgtaaaaaataattataaagtaacaatcattttcatgtctctataaatgaaacaattcaaaataatttaaaatgtaaaaaagagcacataatttgggctagtcagattttctctggattttatcaggagttcatttaccaaaagtcataaaatttgccaaatacaccctcactgtttgccttacaatggacacatattccaaacatagacaagaccacaggcaaaattaagtcttttgctgattttagatacagaccacagagcgacttagctgcctttagccaatttccctgctagctggtcctgctccctgaggtcctctccccttcaaccagagtactctgttcccatccacaccctgccctcctggccatgtctatcaccaggccacacgccgtgcttcgccctgtcctgccaaaatacaggcatgagaaatgcaggaagtttggtgaagtgtgaacatacaggttggttgagaggcttgttttttttcatcttctactctacctagtgaaaattggcttgcttgtgtgcataacaaaatggactttttcctggattgagttttacgtagtcattaagattaaagttgtagtgaaagaggaacatcatattatacttgtatataatgtttagccttttctgtttacaaaggagtatatgatttccaagaatcattttttcacaataaactctttgttaataagtttaattgtgttaacattatgaaatacagacacacacacacacatgccctccttacttagataagagcctaggacctaaataaaatagtcccatactataaaataatgatacaggcttttaaaggaatttttcttgtagttcttacatgctttgcatgaggaccttgtgaagggagtgataaaatcctataaattgtcttagtattgatcggcataacaggattacattagcacctgaactggaacttcctatgagcccatgaacacattcagagagattaactaagacgattttcttttgctattttacaaactaaagtcactttataatttattggcaatgtctttagagggacagaaaacagaacaaaggtcttaaagctactgagcaaggcacggagcttatgatattatatgcaatgataatgcaaaccacaggaaatttatggtgaggcaggaaaatacattatattatatatttcctgagaactggaaatgatgttgtgatcatttgaagttagggaacatctaattctggatgagtaattatttggtttgtacaaccagataacttaccgtgtatgactatcctagaaggggatgattctttgggttttcaatattaattgatttatgtggtatgagattgaattgctaactttcttctggtctgcttgtaaatttctacaaagaagatccttcgccttctgtcctctatagccatccaccctgattagccaatgctgcagtctcacaagcgtgtgggattttatttccttaactaaactatttgcctaactcagagatgtaagctcaatggaagaagaaaaaaaaaaattgactgagttgtaatcatctggagtgtttgaaataatttgaatggatggggattatttgcttcagaaagcctctgtctaacagtattcctaggagctaggaaaaccagcattctaatctcaaactctgacattttttgacaagttgctttagttcccagcatcattctgacctttgtataatgagaataataatatttatctagcttagattaaatcttccatcgtattgttgggaatatttcactttgataaagtgatctttcctttcagattccttacatgctttacaaataaaattgatttaacagtttgctgtttcctattgcatagatgtagaaaccaagacacagagaaatcatattttactgcatattttgagatttaataatagctaatatttgctgagtggttacctagtgccagacatggtacataacctcatctgattctatagtaaccctgcaaggattgtactcctactttcatagtaaagaaaacagtggctttaaaagactaagggagtttcccagaatcatccaatgagtagggggcactgtccagatcacagtgcaagcatctactacccccagcattaccaaaaccaagacaagtcgaagttgtatctcagcaaggtgtccatgaaacaaggtcctggcttggccgcatttggagttcactgtcctattgcctgggctggttacctggtgagcaataacatttccctttccatttctgaagccactctcaaagaccaaccctttagtggatattgtgtctttctttggctacacagcatctgatggccatacttctgatagcaacctcaccctcaatttggaaacccccaaagtttcctgtgaaccgaatgtgaaaacatcaagccccctctgagtcatgctggctgtttcctgccaccagcttgtggcctggttctttgcacccagcgccactggtcaaagctccctcttgtcctctgctcctcatgacctacagtgcaggaattactgaaatgctgtggattagacatttttccctttgctatatgtgtgatgtcttcgcttctctaaggtttaatgccaatcccctcaattcaacacagagaccaattctcccagtgttttccactgcaacattttgcttatacatatcagttctgttatgaaaaagtaaaaaccaaagtagtacgtaaacatcaaagagaaacctccaaaccaaagttgacctgtagccttgacctcgtttctcttggaaaaattagtgtggaaaaagatatttacttgggttgttgttgttgttcttgttgttgagacagggtcttgctctgtctcccaggctgaatcttggctcactacaaccttgaccttccaggcttaagcaatcctcacacctcagcctcccaagtagctgggactacaggcacatgacaccacatccagctaatttttgtacttttttgtagagacgaggtttctccacgttgcccagtctggtctcaaactcctgagttcagtcaagcaatctgatccgcctgcctcagcctcccaaagtgctgggattacagacgtgagccactgtgcctagctgggtttttctacttggttgtggaagactcagtcttcatgggagccaacagaccgaactgctttgggaatagctttaacgtatttggctgtgttttaagggtaatctggggccaggtgctgtggttcatgcctgtaatcacagcactttgggaggctgaggcggccagatcccttgaggtcaggagttcgagaccagtctggccagcatggtgaaaccccatttctactaaaaatacaaaaaattagctgggcgtggtggtgggagcctgtaatctcagctacttgggaggctgaggcaggagaattgcttgaacccaggaggcggaggttgcagtgagctgagatcacgccattgcactccagcctgggcaacagggccagactctgtctcaaaaaaaaattaaaaaatagtttaaaaaagtaatctgggggaaagggggaatagagagagattggttaaaggataaaaaagttacaactagataggaggaataagttgtagtgctctatagctctgtaggatgactgtagttaacaataatataccatttcacatagctagaaggaggatattgaatgttcccaacacaaagaaatgagaaagatttgagatggtggatatgctaattaccctgatttgatcactatacattatatatattgcaacatctctaggtacccgataaatatatacaactgttatgtccatttaaaaataaaaaagaaaagtcatctttcaaagtaagcatttcaatgaaatcatatcacttctcaacttaaaatcctccagtggttttccatcactcccaggacaatactcaaaactcatttttgcactcactctcaaggcttagcctacccatctctccagcctcacctggtaccacatcctccttgccaatcagtcctgccagttttctttcttatttttattttattttattattgctatttctccctctggatttttttttcaaattttctctagattcagggagtacatctgcaggtttgttacatgggtatattgtgcaatgctgaggttggggcttctgttgaacctataacccaaatagtgaccacagtaccccacaggaactttttcaacccactccagtgtctactattcccatcttcatgtttatatgtacccaatgtttagctcccacttatgagaacatgctgtatttggttttctgttcctgcattaattcacttagaataatagcctccaggggcatccatgtggctgtaaaggacatactattgttcttcttcatggctgtgtagtatcccatgtacatatacactgtatatgtaccacagtttctttattcaatctactgggcacctatggtgattccatgtctttgctactgtgaatagttcctgccagtttctgatcacatcacagcctcccatcctgggcctttgcgtatccttccctctccctctcctctttctcacttcacctaaatgcttctactgattagtcatatttcactcaaatcccccccagaaaactttaaaatacacccaagattataaaagaccctctagtatatccttccatagaacatcattctttaccattaaagaatttatcaaaatttataaagatatatttgtccattggtttaaaggtcctctagacttcttgccctgtgagtgcaagaatgaagctagccttgcatatcactgtatccctttcatctaagaatgttctagaaattggtggtgcccaatatttgatgaataaacaaatgaatgaataaatttaagtaggaaaatgtaatatcaaagtgtaaatagtagtcaatcttgtactttctctcttcaatatttacttattgaaaaaagcatgtatcacctttctaatcagaaaaaaacttccagttattaaaagtcaaaaaataacatatactggcaaggctgcagagaataggaatccttatacattgttagtggaaatgtgaactagttcagcccctctggaaggcagtttggaaatttctcaaagaactaaaaacagagctaccatttgacccagtagttccattactgggtatatactcacaggaaatagattgttccaccaaattgttctgcactcgtatgtttatagccacatgtttgtttgttcacaataagaaaatcatggaatcaatcttggtgcccatcaatggtggattggataaaaaaaaaaaaaatgtggtacatatacaccatggaatgctatgcagccacaaacagaatgaaattatgtcctttgcagcaatgtggatgcagcaagaggccattattctaagtggactaatgtgaaacagaaaatcaaatactgcatgttctcacttataagtggaagcattgggtatacatggacacacaaatggaaacaacagacactgggcatgttaaaaggagggaagtggggaaagagctgaagacctgtgaggcactatgttcaccactgaggtgatgcgttcattaggagatccaaacctcagcatcacacaatatgcccatgtaacaaacctgcacatgtatcccctgaataaaaaaaaaaaaaaaaatccaaaaagaaaagagacatttactgtcttggtaaacacctaagtctaagaaagatacccagactctaaaaatatatttagcttaacaaattcatattttaacataaatattcctgccgtaattttcccaatttatttttttcttttgtatttttaaagtctagctcgctcacaacgcgttccagagagggaaaaatagtatatcatttcctagccatttcttaaataccaaacaacatcatgaaatgtcagattttgggctgaaatcagaaaataatttttaagcatacttaaaaatgtataacagtaattataatccaccacccaaaccagtttaaaaattttaatagcatttctggcctaaagtggataggggctgaggagggagaaaaaacgccttccagcttatttttttcaaatataaaagcttgccctgagcagatgcgttttccacagtgctgtcagcagcagacctaattgcttttcatgtaaattaagaatatgtacctttgtttaagcagtaatctaggtcaacaagacggggttggtttatttgttttagcttatgtagagctttgaaatggcagttagagcatggcatgaacgttattcttggcttccatttatttaagaaaacattcctcttttaaactttcttttttccaaacctccacttaccaataccaatgatccactccacacatcacgaaggcatgtaaaaatacttaacagctttgatataagacacttgggagtttgggttgctgctatatatttttacatcttttatatttgttaaagcttgatgaatctgagaatacgtctagagggtaaatactgacttgaaaccatttgcttttgagttgcctcactataattatcataggttttttcctctcctcctggaacagacaaatttggggtattttggtcaaaaaagatataagtactctgattaccagacaaattttgaacatagattatatcatagggaggaatttctgaccgacccctcctggtttatgacagcagtgagctgaagtgtacgccactgatcactggccccctgtgcatggaaaattgtatctcagcaggtgctacctggaatctggcaaaaaggtttgttcatttgtttgcgtgtttgttttaaacacttcctgccaggggagtattttgtgaacaatataccacaaaggaagtttagttttaaagatcaaagatcaattttgctcatataatttgtagtagggtaatatatcatctgtaccaaaatccattatagctgtaatccactggttgtcatactctcataaatatgatgtattaataataaaataatttagaagaattccaggacccatggaagtcatgtagttatatggatgtaaaataaagggactttctcttgaggggacaaattccttactgccattttagtgtcaagctatttcattccgctgtaagagaacattgcaataatgcactcatgattatatatttcagtttttaaatgtgttgttaacaatgaagaaaaatattgaatgtaaaaatatagatttgggggaaaaaacaacattcaaaagattaactactggtcagaaagaaaatgcaaaatcaagaatttgaagaaaaaatattttttcttaagaagctttattaccaaaaaacaaaaagtcatacattgttttgtatttgttttgtttacaagaaagtgaaaattttagaatgtctacactaaatacacccatccagcaaaagtttaatgatgacagtcaagaggaaggccataaaacaaacactggagcaattcaagtgatattagaaaagtgtcaaatatttactacctgttatggggatgggtaaatctggttggttgtttgtttacatatttatgtatgcagtatttatttataatctgtattttttaaaaatgatttatggtatatttctttatactcagtcttctttcaaaaacaaggtagctgaatctttttaaaaatgtattattttaatttatgtgggtacatagcaggtgtatatattcatggggtcctggagatgttttgatacagacatgcagtggatgatcgtcacatcaaaatggggtatccatcccctcaagcatttgtgtctttgtgtcacaaacaatccaattatactcgttattttaaaatgtacaattattattgttacagtcaccctgttgtgctatcatgtactaggtcttattcattctttcgaatgatttttttgccattaaccatccccacctccccctgacccagctaccaccctcccagcgtctggtaaccatccttctactctctatctccataagttcaatctttttgatttttagatcccacaaaaaaaaagtgagaacatgcactgcttgtgcttctgtgcctggcttatttcacttaacataatgacctccagttccatccatgttgttgcaaatgacaggatttcattttttttttttttttttttttttttgagatggagtcttgctttgttgcccaggctggagtgcagtggcgcgacctcggctcactgcaagctccgccttgcgggttcacgccattctcctggctcagcctccccagtagctgggactacaggcgcccaccaccacgcccggctaattttttgtatttttagtagagatggggtttcactgtgttggccaagatggtctcgatctcctgacctcgtgatccgcctgcctcagcctcccaaagtgctgtgattacaggcgtgagccaccacgcctggctaggatttcattctttttatggttgaatagtattccattgtgtgtatgtaccacattttctgtatccattcatctgaggatggacacatcaacagctttggaaggttgcttccaaaccttggctattgtgaacactgctgtacataaaaaatatgggagtgcaggtatctctttgatatactgatttcttttcttttgggtatacacccagcagtggaattttatagttttcatatagtagctccatttttagttttttgaggcagttccaaactgttctccataataattgtactaatttacattcccaccaacagtttacaagggttcccttttctccacattctcgcaagtatttgttattgcctgtcttttggatataagccattttttgctggggtaaaatgatatctcattttagttttgatctgcatttctatgatgatcaatgaagctgagcaccttttcataggcctgtttgccattataagtcttcttttttaattttttttattatactttaacttctagggtacatgtgcacaatgtgcaggtttgttacataggtagacatgtgccatgtcagtttgctgcacccatcaactcgtcatttacattaggtatttctcctaatgctatccctctcccagtcccccacctcctgacaggccctggtgtatgatattccccaccctgtgtccgtgtgttctcattgttcaactcccacctatgagtgagaacatgtggtgtttggttttctgtccttgtgacagtttactgagaatgtggtttccagcttcatccatgtccctgcaaagacatgagctcatccttttttatggctgcatagtgctccatggtgtatatgtgccacattttcttaatccactctatcattgatggacatttgggttggtgccatttgtaagtcttcctttgagaaatgtctgttcaaatcttttgcccatttttaattggattgttagatttttttctatatagttgtttgagctccttatatattccgatcatgaattccttgtcagatgagtagtttactaatatattcacccattctgtgggttgtctcttcactttattgatagtttcctttgctgtacaaaagctttttaacttgatgtgatcccatttatctgtttttgctttggttgcctgtgctcgtggggtattacccaagaaatatttgcccacaccaatgtcctatagagtttcctcagtgttttcctgtagtagtttcatagtttgaggtcttagattatgtctttaatccatttttatttgatttttgtatatggtgagagagagggatcaagtttcattcttctgcatatggatagccagttttcccagcactatttattgaggagagaatcttttccccaatgtatgtttttggcaccttggttgaaaatggtttactggaggtgtgtggatttgtttctgggttctttactctgttccatttgatcaatgtgtctgtttttatgccagtaccatgctgttttggttactataactctgcagtataatttgaagtcaggtaatataattccttcagttttattctctttgcttaggatagcttttgctcttctgggtcttttgtgattccatataaattttaggattgttttttatatttctgtgaagaatgtcattattttgatagggattgcattgaatctatagattgctttgggtagggtggacattttaacaatatcgattcttccaatccatggtggaagaatttttttggttccctctttaatttctttcatcagcagtttatagttttcattatagagatcttcttaggtatttaattttattgatggctattgtaaatggctattgtaaatgggattactttaattttattgatggctattgtaaatgggattacttttttgatttctcttcagattgctcaccgttggcatatagaagtgctactgatttttgtatgttgattttgtatcctgcaacttaactggatttgtgtatcagttctaatagttttttatggagtctttaggtttttccaaatataaaatcatatcatccgcaaacaaggataatttgacttcttctttccaatttgaatgcccttttttttcctcttgtctgattgctctagctaggatttgcagtactatattgaataacagtgatgaaaatgggcatcctggttccattctagaccttagaggaaaggctttccttttttttttctattcagtataatactcgctgtgggtgtgtcatatatggcttttattatgcatgttccttctgtccccagttactttagggtttttatcatgaagggatgtcaaatttcatcaaatgctttttaagcatcggttgaaataatcatattttttgtccttcattttgtcaatatgatgtatcacaatgattgatgtgcatatgctgagccatccttgcatcacagagataaatcccacttgttcagaatgaataatcttttaaatttattgttgaattcagtttgctagtattctggtgatgatttttgcatcaatattcatcagagatattggcctgtagttgggtttgtttgtttgatgtggttttgtcttgttttgatatcagggtaataattgccttgtagaatttgttaggaagcattgtctactcctttactttttggaagagtttgaataggattgatattacttcttctttaaatgtttggtagaattcagcagtgaagctattgggtcctaggcttttctttacaggaagactttttatcacggctttgatctcattacttgttattgatttgttccagtttcggatttcctcatggttaaatcttggtaggttgtatgtgtctaagaatttgtccatttcttctagatgttccagtttattggtatatacttgctcatagtagcactaatgatactttgaatttctgtgaaatcagttgtaatgtctcctttttcatctctgcttttatttatttggatcttctctgtttttcttagtctggataaaggcttgtcaattttgcttaacttttcaaaaaaccaactggttgtttcattatcttttgtattgctttcttcacttcaatctcatttattatttattttcttctattaatttggggtttggcttactcttgcttttctaattcattaagatgcatcactgggttgtttatttgcagtttttcttcttttttgatgtaggcacttatgactataaacttcttcttaacactgcttttgctgtttctcactggttttggtatgttgtgtttccactatcatttgtttcaagaaattttccagttttcttcttaatttcttcattgacccactggtcattcaggagcatattgtttaatttgcttgtatttgtatgttttctgaaattcctcttgttattgatttctagttttattccatgtgtttggagaagatgcttgatattatttcaattttttaaatattttaagacttgttttctgacttaacatgtggtctatccatgagaaagatccatgtgctgaggataagaatgtgtatcctgcaatcattggatgaaatgttctataaatatctgttaggtccatttagtctatagtgcagattaagtactgtattagtcgattttcacgttgctgaataaataatacctgagactgggcaatttataagaaaagcactttaattggctcacaattctgcaatatgtacaggaagcaaacgtctggcatcagcttctgcagagaactcaggaagcttacaatcatggcagctggtgaagcgggaatttgcacatcacatggcaaaagcaggatcaagagaacaagcaggggaggtactaaaccattcatgagatcagggggttctcatgaatggtttaacatttccccctcttgctccatgatccaatcacctctcaccaggcccccacctccaacactgggaaatacatttcaataccagatttgggcaaggacacacatccaaactatatcaagtccaatgttttctttttgattttcagtttggaacatctgtcaatgctgaaagtggagtattgaagtctccagctattattgtattagggcctatctctctctttagctctatcaatatttgctttatgtatgtgggtcatccaacgttgggtgcatatatatttaaaattgttatatcctcttgctgaatggacccctttgtcatcatatagtgattttctttgtcttcttatactttttgtcttgaaatctattttgtctgatgtaagagtagttgaatcttgatgtaactgatttataaaacaaactgttgctttattaatataactaggagatagatgcacatgaaacattgtaaaagtatttgtattatccttgtattcatatgaagaaatgtaaaaataaaataaattgaaattgaatatgtttaatttttttaaattagtatcaaactaacaaaacttcagatataagtagtagaaaattagttggatcattcacaatatccaacaactgctaacattctttatattgaataaatattcaggttggagagagttaacatgtttcacatataactgaagtcttcattttttggccgaaagcaccttctgcatgcatctctctcctttttttcttttttttttttggtctgttgtcctatgttcaatcaatgcatctttgttgttgttgttgttgttgttgttgtattttacttcaatttacaagatacatgtgcaggatgtgcaggtttgttacataggtaaacgtgtgccacagtggtttcctgcacctatcaacccgttacctatgtatttagcccagcatgcattagctatttttcctaatgctctctctccccccaccccaccccatgacaggccccagtgttttgtgtttccctccctgtgttcatgtgttctcattgttcagctctcacttataagtgagaacatgcagtgtttggttttctgtccctgcattagtttgctgaggataatggcttccagctccatccctgtcctgcaaaagacatgatgttgttccttttcatgactccatagaattccatggtgtatctgtaaaacattctctttatccagtctatcattgatggacatttgggttgattccatgtttttgctattgggaaaagtgctgcagtgaacatacctgtgcatgtatctttataataggatgatttatgtttctttaagtatatacccaataatggaattgctgggtcaagtggtatttctggttctaggtctttgaggaatagccacactgtcttccacaatggttgaacaaatttacattcccactgacagtgtaaaagcatctgttgtttcctgactttttaataattgccatcctgactaggtgagatgctatctcattgtggttttgatatgcattactctaatgatcagtgacgttgagcgtttttttatatgtttattgggcacataaatatgtgttcttttgataattgtctgttcatgtccttcgcccacgttttaatggggttgtttggtttttcttgtaaatttgtttaaattccttgtaaattctgggaattagacctttgtcaggtggatattgcaaaaattttctcccactctgtaggtttcctctttgctctgatgatagtttcttttgctgtgcagaagctctttagtttaattagattgcatttgtcaatttttgcttttgttgcaattgcctttgacatttatgtcatgaaatctttgcctatgcctatgtcctgaatggtatttcccagattttcttctaggatttttatagttttgggttttccatttaagtctttaatgcatcttgagttaatttttctataaggtgtaaggaaggggtccagtattgattttctgcatatggctaggcagttctctcagcaccatttattaaatagggaattatttctccattatttgtttttatcacgtttgttgaaaatcagatggttgtagacatgtggccctatttctgagttctcttttctgttcctttggtctatgtatctgtttttgtaccagtaccatgctgttttggttactgtagcgttgcagtgtagtttgaagtcaggggcatgatgcttccagctttgctctttttgctcaagattgtcttggctatatggggtctttttaggttccacatgaattttaaagtagtttttctaattctgtgaagaatatcaatggtagtttgattggaatagtattgaatctatatattgctttgggcagtgtggccattttcatgatgttgattcttcctatccatgaagatggaatgtttttccagttgtgtgtttcctctctgatttccttgagcagtgttttatagttctccttgaagaggtcctttacctcccttgttagctgtattcctaggtattttattctctttgtagcaattgtgcataggagttcatttatgatttggctctgtacttgtatattgctgatgtgtaggaatgcttgggatttttgcacattgattttgtatcctgagactttgctaaagttgcttattagcttaagaagcttttgggctcagacgatggggttttctagatataggatcatgtcatctgcaaacagacacagtttgacttcccctcttcctatctgaacaccctttattttttctcttgcctgattgccctaggcagaacttccaatactatgttgaataggagtggtgagagagggtatccttgtcttgtcccagttttcaagtggaatgcttccagcttttgcccattcagtatgatgttggctgtgggtttgtcataaatggctctcactatttggaggtatgttacttcaatacctagtttattgagtttttaatatgaaggaatgttgaattttatcaaaggctttttctacatttattgagataatcatgtggttttttgactttggttctgtttatatgatgaattacatttattgatttgcatatgttgaacgatcctttcatctggggatgaagccaacttgatcatggtggatgagctttttgaagtgctgctggatttggtttgccagtattttatggaggacttttgcatcgatgttcatcggggatattggcctgaagtttttttgttgttgatgtatctctgtcaggttttggtatcagaatgatgctggccttataaaatgcatttaggaaggagtctctctttttcaattgtttggaatagttttagaggaaatggtaccagctcctatttgtacctctggtagaattcagttgtaaatctatctggtcctggatttttatggttaatagactatttattactgcctcaatttgataacttgttattggtctattcagggattcaacttctgcctgattctgtcttgggaggtgtatgtgtccatgaatttgtctgtttcttctagattttctagtttatttgcatagagatgtttatagtattctctgatggttatatttctgtggggtcagtgatgatgtcccctttatcattttttattgtgtttgagtcttcactcttttcttctttattagtctagctagagttctatctattttattaattttttcaaaaaaaaagtccaggatttgttgatttttgaaggtttttttttgcatgtctgtctcctttagttccactctaatcttgattatttcttgtcttctgctagctttggggtttgtttgttcttggttctctagttcttttagttttgatgtttggatgttgacttgagatctttctagctttttgatgtggacatttagtgctataaatttccctcttactacttctttagctgcatcccagagattctagtatgttgtctctttgttttcattggtttcaaagaacttcttgatttctgccttaattttgctatttacccaggagccattcaggagcaagttgttcactttccatatagttgtgtggttttgagtgagtttcttaatcttgagttctaagttgattgtgctgtgatctgagacactgttatgatttcagttcttttgcatttgctgaggagtgttttacatccaattatgtgaaagattttagggtgtcatttggcactgaggagaatgtatattctgttgtttttcgagggagagttctgtagatatctatcaggtccacttgatccagagctgagttcaagtcttgaatatctttgttacttttctgtctcaatgatctgtgtaatattgacagtggggtgctaaagtctcccactattattgtgtgggagtctatatctctttgcatgtctctaagaacctgttttatgaagctgggtgcttttgtattgggtgcatatgtatttaggataattagctcttcttgttgcattgaaccttttaccattctgtaatgcccttctttgtcttttttgatctttgttggtttaaagtccgttttgccaaagactaggattgcagcacttgcatttttctgcttttcatttgcttggtaaattttcctctatccctttcttttaagcctatatgtgtctttgcctgtgagatggatgtattagtctgttctcacactgctaataaagacacaccccagactgggtaatgtttaaaggaaagaggtcaaatgtactcacagttccacgtggctggggaggactcacaagtggtggaaggcaaaggagaagccaaggcgtgttgtacatggcagcaaggcaatcatacaagggaacttccatttataaaaccataagatctcatgagacttactacgacaagaacagcatgggggaggccactcccatgattcaattatctctacctggccccacccttaacacacagtgattactacaatttaaagtgagatttgggtggggacacagccaaaccatatcaataggtctcttgactacagcacactaatgggtcttggctatatccagcttgccattctgtgtcttttacttggggcatttagcccacttgcatttaaggttaatattgttatgtatgaatttgatcctgtcatgatgatgctagctggttattttgcagatttgttgatgtagttgcttcatagtgtgtcactggtctgtgtacttcagtgtatttttgtagtggctggtaagtttttccattccatatttagtgcttccttcaggagctcttgtaaggcaggcctggtggtgatgaattccctcggcatttggttgtctggaaaggttttgtttctcctttgcttacgaagcttagtttggccagatatgaaattttgggttggaaattattttctttaagaatgttgaatatcagcccccaatatcttccagcttgtagggtttctgctgaaaggtccactgttagtctaatgggctttcctttgtaggtgacctggactttctttctggctccccttaacattttttccttcatttcaaccttggagaatctgaggattatgtgtcttggggttgatcttctcatggaatatcttattgggattctctggatttcctgagttcaatgttggcctgtcttgttaggttggggaagttctcctgggtgataccctgaagtgtgttttccagcttggttccattctccccatccctttcaggtaccccaatcagtcttaggttcagtcttttacatagtctcatggttcttgggggttttgttcgttccttttccaaatgcatcttttaacattgtgagatattctaaacagtcattttgtaaggtctcaaatcccaccatacctgaaggtttgtttctatcagaaataattcaaagtttgatttgttatttaaatgatttttgtcttacatgttgagtccaaagtttaaatttcatcactgcttcttgacatgccagtgaaagcatggcaacacagtttaaatcagcaaattgagcttattattaaaaataccagcaggataaacaaattcgatcagtgaagttgagaagtatttaagtaatgttattgtaatcagtacaattaatagcattttttggtctcacttgccattttaattgtagcatttatcttcagaacatgcaacaaacttcagtttttgaaacattagaatttatgaaaacaggaattctggaactccctaccaatagaattaacaaaactctaaaaattctgcctgtttgacatgcatatgacattatctattggctagtgtcattaatctcacctcctaaatttcactcgagcctttttaatgtgggggttttagatgctcattggcaactgttgtatcagcagttctcttgctgctgctgtggctgttgaaatagttcccactaagctttccgtcctttttcaatcacttttccaaactgcagtcagagtaatactctcaaaacacaaacatgatgacgatgtctcctgcttaaatccctccaaaggtttccattgttctcaggatgaaaatcaaaatcctaatatgccccaccacacactgcttagttcagtccctttgacacccaacctcctgctacaccaccaagtcaatggctctgagccccaaaactggacttctctcacctcctcaaactcaccattctcccttctatcacggggtcttgtgcaggctctcccttccttctggaagattctccatcccagcatctcactcttgctccatccaacctagataaatcccaacttccagatctgttagaaatgccacttcctcaaggagccttcactgggtcccttggtccttctgtgctgtggtcctacagcacgtagttgttgtatgttacaactgcatctgtgtgtgataatctgattttttttttcaagatggagtcttgctctatcgcccaggctggagtgcaatgcatgatctctgcttactgcaacctccacctcccaggttcaagtgattctcctgcctcagcctcccaagtagctgggattacaggcgcccgccaccatgcccggctaatttttgtatttttagtagagacgggttttcaccacgttggccaggctggtctggaactcctgacctcaggtgatccgcccaccttggcatcccaaagtgctaggattacaggcgtgaaccaccgcacccggccgataatctaatgtctgtctcactacatgagggcaaaggctgtgcctggctttatatcccccaaacccaaaatgacacataatatgcacaaatcatatttgctaaacaatggaatgaataaatattacaaacacttttcaaagaatgtggcatttcgatcatctagtgttatctctgcagcatgcaaagaccactcgcacacattttggaaacactttttataggaaccgctactcttgctttcttcatgtgttagtctagtgttaaaatggcaagtgagcccctaaaaaagttattaattttcctgataaaaaaattacttaaatacttctcagccacaactttattaaactaatttatcttgctgattttttttataacaaactcaatttactttttgaaatggttttgacagtcaacagatctcagtgtatttttgccagcttatttcatggtgtgttgaaaactgccctaaactcttaaactgtgccttcctcttgtgtgttatatactttttaaaaagtatgaatcttccttatatccatttatactaacaggatggaaaaaaataaaaataatggagttctatatagatgtactctcattctgttaaactgtgaataattcatactctctccccctccaatccaaactccttttatttttttttttttgtgacacggagtctcactctgtttcccaggctggagtgcagtggtgcaatctcagcccactgcaacctccatctcctgggttcaagcaattctcctgcctcgggctcctgagtagctgggacttacaggcatgtgccaccatgaacagctaatttttgtatttttagtagagacgggtttcaccaggttggccgggctggtctcaaacccctgacctcaagtgatccacccgcttcggcctcccaaagtgctgggattacaggcgtgagccaccatgcctggccaaacttctttatcaaatatattgtaagtacagttttagattctttggatcatatcaccaaacttctatatcaaatgtattttcctaggagatagttgttcagtatcagcagaataaagtttaatcatttatctgcaggagcgagttaccaccccaagggcaaggcagcaactttctttgaattatgttatttgtttgtttgtattggcacatttaaatgttgttttcatacattttttcctatggtgtttagctagtgaatttacacaggaagcatcggcatcttactgttatgctcactgtgatttgtttgaaggtaaaattgaaacttggtgaggagcataggacatattcctacgtaacgacactgaggatttaagaaaattttttatttttatttttagagacagggtccctctttgtcacccaggctggaatgcagtggtgccatcatagctcactgcagcctcaaactcttaggctcaagccatcctcccacgttagcctcccaagtagctgggattacaggtgcatgccactgtgcctgggccaaattttaactactctaatgataaaacaaacaaacaaacacctctcattatacttttttctacttcgcgtgattttgctcaagtactttcaaacacacaacacatttgttccatcctgtattgttcatctcaagatagtctatgctaactgagaggtgagttggctctagaagaatatgactagcttcattctgagtccaatttcaaacatccattggcaaagattcattgataacttcttcttaccaagcaagattctgttcctggtctaaaaagcaatgatttccgctaactagggcaaaattatttcatctttatttataaatataaataattgtaatttaggatttcaaattattattaaatgtattagtattcttttaagtgctttacaaatgttaactcattttatccacataacaaacccctgagaaggtatttcctgcccattttaaagtggcagtaattaagaatagaccatttaagtgtcttgctcaaggttatactgacatagctgttctgtggcagagttagagtctgttcgcaggcagtctggttttagatcctgcacttaaagcatctggcacttcaccgagcctatgacatccctgctgtagtagggcctacattgcaacaattacatgtggcaagatctgcacagacttgcgttcaagaccaatgcagagctatagacttcttgaatagctgcaggaagctaaaatacgtattttattttattatgattatttttttgagacagagtttcactcttgttgcccaagctggaatgcagtggcgcaatcttgactcactgcaacctctgcctctcgggttcaagtgattctcctgcctcaggctcccgagtagctgggattataggcgcccgccaccatgcctggctaattttgtattttcagcagagatgaggtttctccatgttggccaggctggtctcgaactcctgaccttaagtgatccacccgccccggccttccaaagtgctgggattacaggagtgagcccctgcgcccggccataaaataacatagtctaaaagatgaaattcgaatccaactttctagaaaccctagaacactgcctcaaaaatcttgggttttcaagagccatctgaggtccggagctaaagtgttcactccaccaatcgctttatttccaggacatggtggctcaaacgcctcaagatgtttgaatcctgttttcttggttgaaagacttttaaattttttctttcagtaggggaatactgatctgtgggcacggattgccacacaccccagttaaatcacctttccctgctcaggaaaccacttccagcgtcaggatgtcgcatctgttctcccactaccccttgatgttttgtagaaagccccttcattgggttcatctctagcagttgtttgctgtgccatggcagcactggtgcaaaaagtatgcttaggtacacagcagccagtctgaagtagtgggaagctttttaaataaaaacaccaaggacatatatgcagtaacctacttcaggttcccactgtgtgaaaaaatcagaagaattaatgcaaaagagaagacaaacatgaatgatactataacatatctgtagtgatagatatgcacatatacatacatacatgacacacacatgcacgagatagcctgggatagacgattgtcactgatatgatcatgaagaaaaaagcccagaaagtaacctcattccctccacagatgctttatcttagagccactttcctgtccctgtctggtacctagcacaatgcttaaacgaataaaaagtgctcagcaaacatcagttaaataaattaataattgaagaaagagaaggaggaagttgggaagggagggagggagaaatggaaacgaaaggagaggagacgaggaggggacaggaggggatggaaggggagggaaggggagaagagggcaggggaggctgaggtgaggcgataggaggggaggggaaggcaggggaggggaggggagaagagggcaggggaggggagggcagaagagggcaggggaggggagggcagaagagggcaggggaggggaggggagaagagggcaggggaggggagggcagaagagggcaggggaggggagggcagaagagggcaggggaggggagggcagaagagggcaggggagggaaggggagaagagggcaggggaggggaggggagaagagggcaggggaggggagggcagaagagggcaggggaggggaggggagaagagggcaggggaggagaggggagaggagaggagagggagaaggaagggacaaaggcaggaaagggcttaatcaatcaattgaacacagtccggtttccaaagtcatctactcctttactctttcccatatcttctgtgccttcctgactttccagttttttgcaaagcaaattcccaccttgggttatttctcagttagtggcttacacagagtttcctgggaaaatcatggaaacctcccaacaaggtctagaacatacctattctactccatctccctagatttctatttaatcttttgtgctcacctacttataacacccaatcagcctctccggtccttgttcacagttttcaatttcccaagtcaccaatttcgttcatgccaccacaccctgcccagctttctgaaaaactagttttctcccagtttccatttttctgataatcatattgattatctcttagtcaacaaggttcaaacctaaaagtaatttcttactccttctctttgcctctcctaaatcctccatggttttttgttgttgttgttgtttgtgtgttcttgtgttcgttttttgtttcttaatgtaaggtgaggatcagggaaagaagggggacagagaaaatgggactcactgtttgacactggaaactactccaaaaggctgaattgctaaaatgagaaactcaaggcattgatttacttttgctgtgactgtggtttaaaatgactgagtgacatgcaaaaataggaaactcctgtattttttttcttcaatattaccagaagcaaatatttgtaagttcacactgtagtgaaactaatcctgggctccaggagcacagcgtaacctaagatctaattagaagaaagagaataaagatagtctattccaggctatctcgtgctgtgtgtgtgtcgtgtatgtatgtgtatgtgtgtgtctatccctacacatacgttatagatcttcaacataaccttgatctaattcctataacatgccattgggatctgcaacagggacaggtatgggagggcctttaaacaagatagaaaggtgtcagggcttaggtaaattcttcaacatttcactttttgtaatgataaatagccatataaatttattcattttaaactactggaaaaaaagcaaagactctatgtgaacacataaaataaagctcagcttaacacactgcttgggtagcctgcaaacattgttcctatggttatttatcatcttttctgtataactgtaataaatcaatactaatcccttgttataatacagctgataattttcaaaaagtattagaactaaaattattcatataaaccatcttatcaaattttcttccagtttatgtgttttatttattttattctagatttcctgctcttctaagacacagtgatttagaatttctgttcaagcaagagaactaaagacttctttaaagaagagaaggtaagtcccaggaaccaaaatgtctccagtcttagaggcttcttcaaatatgcagctggttggtcttgacaaaataagttactttcacgaagctacagttcactttgcagtccattacttatgctattacccttcatgaattagctgtaggtaaatgattccaaaaagtataattaatttggttctcatactatttctacaggcttttctttttctggaaaatcagatgaatgaggacattcgaaagtaaagaatctctgcattttgactagagagaattttctaccaggatgggatagaatgatcacaatggattatagagtgtgtatggtgtggtgtggtatgtgtgtgtgagtgcacacacacgtgctttccccagtttggaagtgatttgttggggagttctcttgttctcaggaagtcttaatcctttctgatcagcacttacatgtcaaccttagagaattaaacttgtacctggttacttttttctctctccttgatatagctcaatgcgttttctcaaatggtaaccatggtctagcaatttaaagcctttgaaccttgtgaacagattcatttaaaaccatattctgagggctttccataaaatggaaagtgtcttctaccaggaagctacaaaagaatttacaagagaaaatctgctaagtgtccccctcaggatgagtgtacagtaacatgtccagaagatccagtgtcctagaggaagtcattcacaaaggtcctgactctttgggcttaatgggttgaactctgaatttctttgctttctcctagtcgatgctgtgtttcttattttaatacaaaatttagcaaaaagttttcatgaagtaaaggactttctaaataaattacaaaataattataaaatacgaatatgtaggaatgtcgacatttttacatcagagaaattgagttatacgagcatatttctttttgatgctattcattcaaagacaatatattaagtttttaaaatgatgtcagaagtttagagggcatgcatacatcttaacagtctatgacaacaactgtggttttgtcactggtactattttgtgttcaggttactgtatctgaattaattttcgatccaaaacaagttatcgtgtgtgcgtgtgtgtgtgtgtgtgtgtgtgtgtgtatgaagctgacactaattcagtattgcaaaaagagttttttgctattccatttaagaagagagaagataagatagaaggtcgtctttttttttttaagaataaaattgtggtgtaattttgcgtaaaatagcagcaactactattgttttattttaatatccatctcaagctctgcgtttttacatttcccctaagggcatctcagagaaaggggataagagagaactttaataagcattcctgcgtgcacacatacacattcttacatgcccagtgagtaattaatcaaaatgaaaataaaactctggaatgaatagctagctatgttacgtgccatcttcggtatacagggtatctgtcttccgttgatctcaatttaggtaaaggtgagactttcacgttaagctaaaacagttaatgcaaagcagattttaataatttaccattgtgtatttcttcagttattgttcttttaagatcctctgtaagaatttttgcactatattttgtacaactgcctgtagaaaccaagaccctagaaatgtgcatgcaatatacatgtaacctagataagtgatgatttgtctaagttgctctgctgatattttcctcaaatcctcctcctgacttctcttttcattcaaatgtgaatcattacacaagcatacactgtgaaaaacctatctctctgtctagttttataatagacttcaaataaattaaatttttaggataaattattattgaagtatccggggaattgggtgcacagttcttattactaatgggagccacgcacctaatttcaggcactctgagctgaaatgtaatcaactgtgtgttttctgctataaaaatataactcaatattcagtgcaaaagcaatccttggctctccgaagcccattggcgatgagattccttcaggtcttaggcatttcgccttagaaaaagcgctccctacgaaagccactataataaaaacacgccatcctccccttgtcttgtaagttctctctcttcaaatccttctcttgccagttcgtgaattccactcttcccacactggaagcttctctaggacaagcagttcgtctttaatagctaatatagaaacttgaatgttatagtgttcctctgagatacatattgaaggataaattttcctatgtgatggttgcagctatggaggtaggctactacctttaaaatacacatataaggatatatcttgatgaggaaacaaaagttaccatccacataccaccaagctcttccaaaagcaaggagaagaacgacatgctttctaaccttggaaaagcacaaaaaaagaaaagaaaaaaacacacaccaacaaaaagaaaggaaagaacttcaaaagagtttcttcaaactatatgatttaggaagatgtcttgagtgtgcctgtcctgatttacagcagatctagtgggtatgctcttactgcatacgttttaactaatgctttccagtgtgattatgaatacactttatatgtcctaaggtcacgcagatattttaactaagcctaacaaatactcagaaacatgtcttaaattaaaatatgacaaaataatgttttccaaaaagggcactgagaagaaaagatcacacaatttccatggcacagaatcctgctcgtttacgagaggtggtgaagaggatagaaaacatgtaaaatgttatgtggtctgttttcaaaatggagaaaaggaatatcataaataattgaaatccccagattagccaaggctatcatttttttgtcagtaagctccaccctttcccgggcctttatagaatggaactcaagattgcaaagcctttggcttgaataaaaattcttctttctttttcctgccgtattgaccaaaagggaaggggaaagggaaatcagagggcccacatgatactcaagacggatagtccctccctgcctcaacagggattggaagctgatatatcactatctagcgcataagcaaagaagtggacgagatgaaagaaacagcataaattaacaatgtcaaaaaacatcataagcctctctgatgattacaagtatctctatgtttgttgtcttgtagaacaaaaatcagaatggctgactgcagatttgacttttcatctggatgtttcggtgttttgcaaacagcgtttggtgcaagggaaaagttagagttttaaatctgtgggacacggtgataatttttcactctacttcttagtcctgtccttctgaatgagcagggccatctctgagcctgggtgtgaggagtgtggttcaatgcctccagactgtaactttctgaagttttcagtctgatttcagagaatcctgaggagggtctgtacccaaggaagcgttcaggctgattgaatgctttgattgtgaatgtttggatctgacttagtagaagcgaatttctaagtacgatgtccatgtctgtatcctagcctcaattaaaaaaaaaaaaaaaagattaagaggctaaatagattttcttcttgctgaagtacataacctacgaaagaacaggaacagaagaccgaagtttagaaaaaattctcctttgttaggtcattgcgtttttttaagggtgaattgaagttgaatcgcgatttactctacattgggaggttatagagtgagcaaaatggacttgttggggctgtcccaaggatagtgaaaaaatggcagaaataactatttaaggcagagaggttgttggcaaagtcactttgaaacatgataaaaagcactactctgaagtttattatttcaatttagtctgtgatcagatacaaagcattaacctcacagacttaaaacctaggccgggcacagtggctcatgcctgtggtcccagcactttgggaagcataggtgagacaatcgctggagcccaggagtttgagaccatccgggttatagagtgaaacctcatttctacaaaaaaatttaaaagtaaccagatatattggcatgtgcctgtagtcccagctgcttgggaggccaggatgggaggatcacttgagcccaggaggtcgaggtcacagtgaaccatcaacagaaaacagtcaggagaggagcaaagcaagatgaccagaggcaaggggacaaaagcttctgtttattaactcaggaatcagagaaagtatttcctagggtattatacagttttttaaaatatgtggtacctttttgctttcagttttctaatcagtaaaaataaatagataaaatgctacatgaagtgccattttaaatcatgaagatagcatgggccttggaactaactgaatgagattcagattcttattctgtcactttctaattcttacaaattggaaatattatctttttatatctcagtttcttaatctgtacagtagaaataatatacctccctactattgatttatgaagacaaaatttgatcaatctactaaggtatctgtaaactaatgctcaacaaattgtgcactataaaagcacctttaggccaagcatggtaatcccagcactttgggaggctgaggtgggaggatcacttgaggtcaggagtctgagaccagcctgggcaatatagcaagaccccagctgtacaaaaaactaaataataataataataataataataataataacaaccaggtgtgggggcatgctgctatagacctagatactcgagaggctgaggcaggaggattgcttgagtcctggaggtcaaggctgcagtgagccatgatcctgccactgtactctagcccaggtgataaaatgaggccccatgtctataaataaataaatgaagatacctttgtatataacacaataatttctgcctattactattatttgagataattatttcagaagagcaccatgtcctatagcaggtttctattttgaactttcaatcccaagactttttaggtagcgtgcagatatcgtcaatgttcttataggcaatgccaagaatttttcttttttaatgcagcagccacaattcaagcatagcagatcctacctctctgatcacactgcaataagatttagggaggtgcaatgaatgttgaaagctttacctctaggaaatgtagccaattgccagttttctgttgaagtcatctttcttgttagcttctgactagaaagttctgctttaggaaagattaccagaggtaaatatgcctgataaataggagggttagaagggatggtcatgtctagtttcagagaactccactactaaaaggactgtcataattccacttgctgacactggcaggaaacatggcaagtatatagaaaaatctccataagtatgtgttaaatgcatgaataggctggacgcagtggctcatgcctgtaatcccagcactttgggaggccgaggtgggtggattacgaggtcgggaggtcaagaccatcctggccaacatggtgaaaccccgtttctactaaaatacaaaaaattagcggggcgtggtggtgcacacctgtagtctcagctactcaggaggctgaggcagggaaatcacttgaacctgggaggtggagattgcagtgagccgagagtgcaccactgcgctccagcctggtgacagaacgagactccatctcaaaaaaaaaaaaaaaaaaaaaatgcatgaataaatgaaccattttcccgggaaataatatagtaggcagcatctattctaggagcacagagatggctttgaataaccaacactgatattcttaacgttgtgtagaggcagcaactcagaattctctgaccttggctcttgggtttcagcatcgtataagtgcatcgtaccccattcatctgctatgtatatgtctaaactgagcctcatcagactataggtgctttcagatcttttgattgaaatcctttccaattatgacgttatttatgagatacagttttccacagctgatttatctcttgctttgtgaacctgactatataagaaatgtcataccaaatgagctcagtgatccatgcagcccagtcgattccccgcagtggccccgaggaatattctacaggagtttgtggttgccatgcagatattacctaaataaacctctttaatgtgccctgataattcaccaataaccttttataataattctcatataagaactcatttaatcaatgtgaaataagctaaaagtaaattttcatcagttccccccacaattttagcaaagttccttattgtacaaatttagatattccagagttcacatgatgatggatactaaactatgataaaatatgattagccagaaaataattgttatctactaacaagagtatattttatttagtaagcattacaagtataggtgtgtatcaaagtaaaatatggatttcatagattactatctacttccatttttttcttttctcgttttcctaagaataacacctccttagttcaccgattttatgtttacttaatccaaacacatagatattaccagataatcatgctctttgttgatttataacatctgaacaagactaatagtgataaattgttcaactacagcaaatttttagaagagtcagatgtaaaaaaatattcaatttgtaaacacaacaaaactcagttgaattcacaaaggtgacttcaatcgaatagcatgttcagggtaaaggatatgtttttgtacctctataaaggaaacttttttctttttacatatgtaccattcaagtgccaaaaaagaaaaatccctctcagacactgtttattgaaagaaatttcatgagagccaatctcacttttccagcagagcagcaacctacctttctaaaaggagagcagatgatgcttttgaaaacactgcctgcctgttgcaacacacttatttaaaaatactgtgtctattattcctgaacacttaagagtaaaacctcattgtaaatggtgttatcaccaggaatggtaagttgttttcatgcaagaagttcaaaatctgctctgatgtggccaattagaggagctttctataactccttaggaccaactaagggtacattttgttgtgatgtttttaatagttgggtcctcatatccttctgacccacatagcatgggggagtcaggcagcagctggtacttctcagagtcactcaaggagaaactggcaatttgtgtgctggcttctgtgtgtgtctctttctatgtccagctatagatctacctatcaccctttttctctgttcaattacttaccattgacacacttcgtgaacaaaagttctttggttcaagcatgatcttagggtagatttatataaagtgcaataggcctttatccaaagaatgaggtgtgcaaagaaaaccctgaatcagtactccctcttctgtatcagattttgaccttaagacctaccttagtgtagcttgtagccagttagaagacttgctttcctctaccctggaaagggacagtgagaggtgggcggagaaagcacttcagctattctgctcttcagagtggtcagcaacctagtgtcacctggaattgcctcctgggtcctctacccccattcaaacgtcacccattagcttcagcggggaagttcagcgtgcaaagcactgacgcataacgtctctcactgacatgagccgtatccctgctcttgatggatttttaaaatcacaattacattaaatgccaaatttcaaaatcaagggaaagtggcactcaaggagagatctgattaccgtttaagaggaaaaggaaaagtctaagaaggatttgagtgccagtcacagatctcggcatcggcgacagcttaaatggcgtttatttatctttaccatgggtgagatctgtggctatacacaaatatctcttggggagtatcacgtataaatcagggaacaattaagaacttggtgctgatcctttcagactgaaaacattaaaacccaggcattggcctgtagttgagaaaattgacttagaagagaaattgagtccttaaaggcaagggcacgtttaaaaaatatgtattttttttaattaaaaaaaaatttttttttgaggcggagtctcactctgtctcccaggttggagtgcagtggtacaatctcggctccctgcaaccttcgcctcccaggttcaagcaattctcctgcctcagcctgctgagtagctgggattacagacacctgccaccacgcctggctaatttttgtatttttagtaaagatggggttttgccgtgttggccaggctggtctcaaactcctgacctcgggtgatccacccacctcggcctcccaaagtattgggattacaggcgtgagccaccacacctggcctaaaaatatgtatttctttaatttgtgtgtatcccttgttggaatacaaaagatgaatcaaacatttatctgacctacaaacagttctcagattgttaagggaaataagtcataaacaaaacacatcaaatacagtgattcatgatacagcaaaggcccagtgacatgctgtgaaaattaagaggaggaaagagactagtgcagaatttctgaaagaaaattctattgtggctgactgcggtggctcacacctgtaatcccagcactttgggaggccaaggcagacggattgcttgaggtcagtagttcaagaccagcctggacaacgtggcaaaactccatctctactaaaaatacaaacactagccaggcatggcggtgcacacctgtaatcccaactactcaggaggctgaggtgggagaatctcttgagccccagagacaaaggttgcagtaagccaagactgcaccacagcactctagcctgggtgacagagcaagactccacctgaaaaaaacaaaacaaaacaaaaaagaatgcaactttaatttttaaaaacattatattgtttaaactagatggcacaggaatattcaaatggcctccagagatcatcttcagccactggcgattacagtggctggcataggaatgcaaagcgcccacattctgttgagtcctcagttcacatctgctcttggtgtgctgattaatgtggcagaaaaatatgtttcaagactccttgggccagagataaaagcaaatgaagtctgggcatggtggctcatgcctgtaatcccaccattttgggaggccgaggcaggtggatcacctgaggtcaggagttcaacaccagcctgaccaacacggtgaaaacccatctctactaaaaatacaaaagtagccaggtgtgatggcaagcgcctgtaatcccagctactcgggaggctaaggcaggagaatcgcttgaaactgggaggtggaggttgcagtgagctgagattgcaccattgcactccagcctgggcgacaagagcaaaactacttctcaaaaaaaaaaagcaaatgaagttatttttcctctcttttttttttttttttggagatggagtcttgctctttcgcccaggccagactgcagtggcgctatctcgcctcactgcaacctccgcctcctgggttcacgccattctcctgcctcagcctcccaagtagctgggactacaggcgcctgccaccgcgctcggctaattttttgtatttttagtagagatggggtttcaccatgttggtcaagatggtctcgatctcctgacctggtgatctgcccgcctcgggcaaagtgctgggattacaggcatgctatttttcctttcttaaagagcataatttattcacttaacaaatattttctagttgcctactttggaggaacaaatgtggtattgtctgggcatataatttatagttatagcaaggttgccctgtataacacaattagatagttgaagatttcagaagttttaatactttgagtacttaagatcattgcaataattgaattaccttctcagaaagtcatgttggagacaaagcactaaagattaccctaaaatgttgttctagtttatctgtatagctcggtgttttcaaatgaggacaggtttgcctctcaggggtcatttggcaatatcaagagccattttcccttgtcaccgcctggggagggggtattactggcctccagcaggtaggggatgctattaaacatcctacagtgcatagagaagtccccacagcaaaggattatctaaccccaaatgtcagtggtgccaaagctgaaaaatgctggtctaggttatattaatatttctacttaagtcgcctcttacaagccccagaaatcatgaagatcctgcatagagaggccttttatccatagacctcttatgaaggaacaggcacctgagttacacaatcaaagagcccagctagatttgggtcatgtcatcagaagcaagagcatagtgtcaatgagatgggggagagaaggaaacggtaaacatggaactcaggctacagaagtgtgcaagctgacgttcccaccaacaggtgggaaatgggcttcgggaccacagaggccagcagtgaagctaaattcagaggcattgtttctcaagggccagctgggctgttgaagcctcgccaccaatagctgcctgcttaatggcagcaaggttgtaccttttccctcgttttcatagccacaaacctcacttcttcacccttcagtgctttcactcagctcttcacctcggagctctgcatttgcctaacattcacctaacattcctccccaccctgttcagacttccccacaactgagttctctactctgggcgagtcagtcatcacaggatcacagcagatgggaaatgggggccaatggacctgctcttattgccaggagtgcattgggagtaaagtgtttctgtaagtcaaggatgagaatataaactcatttctccacataaatatttttatacgtgggaatcaaactctgaggttccagctttaaaaggtgtcctaaaaatctgatgaacttttgtgtttgtatatttcattgcgttttaggccttaaagtcctgattcaaatatagcattttagcagtatatatacatatacattatatataatacaaatgggatctaatgggatctcactatgttccccaggctggaccgaaacttctggtttcaaattgttctcccacttcagcctcctgactagctgggactacaagtgagtgccacctctcctggctttttagcagtattttctatgaccagatgagatgcaatactcccaggctatctcaggcagctgtgtaggctcctctacaaaccaaaaatggttcacactgtataggaatttgcagttggagggcatatttcccattcattatctcatttgtttctaacacgagcccagaaaagttggggctccttcagcacagtgcttagcgtttagtggatacacaatgagtagttgataaattaacaaatgcccaatattttgaaatgataaacacattctgattattaaaatggcttgcccagtgaaacatggatgcttagggacagctcgagtgccctggccagctaattgcccatctagggcattctcatactgcctcttgggctgtgtctggtccaggatagacccatgaccacaggggtccacagtggcactaatcgatgtcctgggccccagggtggcagctctgtaggaggagaggtactgtgcacctgagctttgcctgagtcctttgcagcccctcaagtggggaggttgctacagcaatttcatctgagacagctctctcctgctctttaaggcaggggaaccctgcttttgatttattttgtatttcaccacagggctgaacacatcctagaggcatttaatctgttcacttgaattgatctcagatgctgggcttggcctgatatgaaccttcacactgtaggactcagcaggtcataggaactcatttccgtttaaatcccaggcccctgacagctcaaccaactctctctggggtccatgggtctggtcaaaagatcgtagctttgacacttgatgcagttaaagcaaagacatgctcttcctcccgagtctgtaggttgaagacataagatgatcaaagggaatgatgtcgatcgcctgctcaaaaactctcccttacctaaagaatcaagcataaaatcaatagcccagcattcctgccctcatttaccttttcaaacttatctcttatcactcatttacatcttccatgtgctccagccagcctgaaccgtcttggtgacaccatacagaagatgcacacatttcctctgccaagatggcctctcccttctctcctcctgcccactgcccatctccgtataacccagtccatctgattgattcactgtcttgttcaacaaatatttattgtatgtctgtaagtgttagacggtgtgctcagtgcttggaataaagaggtgaaagagactcatggtcacctgtagagattaatttctttagcaacagcttacgtgaaacaaataacttgattacatagttaccaagtgtgacgtactgttaggggagaaattaataggatcttttgatagagaataacaggagattgggacaaaaacaaatagaaagaatgaataagacctactatttggcaacataacatgatgactatagtcaataacaaattgtacatttaaaaataactaaaagaatgtcattagattggttataacatgaaggatattagattgtcattagattggttataacatgattggttataacatgaaggataagtgcttgagtggatggtaccccattctccatgtgatgtgatcattatgcattatatgtctgtatcaaaacatctcatgtgccccataaatatatacacctactatgtacccacaaaaaataaaaattttttaattaaaaaaaagaataacaggagaattttacttagaaggagaggtcataggagactccttggggaagatgcctttcaggctgagcactaatgccatgtgagagctggaagaagagcattccagaaccagagctcggaggtaggagaagtttatctgcgagcctattccttgatgtttcttctcaccaccaacctacccacactggctcccagttggaagtaacatttacttccttccgtctctatggatgctcaaccaggcacagtggctcatgcctttaatcccagtactttgggaggccaaggcgggcagatcgcttgagcccaggagttcgagtccagtttgggcaagatggtgagatcccatccctacaaaaaatacaaacattagcccagcatggtggtgcacacctatagtcccagctactcaggaggctaaggcaggaggattgcttgagcctgaggaggtcaaggctgtgagccatgatggtgccactgcactccagcctgggcaacagagcaagaccatgtctcaaaacaataaataaataaataaataaataaatagacctcccacagatgctacatgttcccctcttgtgatatgtctcactcacgctctggctcggttaagctcatttatctcacttcccttgaggatagtatgcatgtcaaagtcacttttgaggtcctgccttgatgatccttgcctccttctgctctggacacccggcagaggcaggcagctaccttcctggggctaggaggttcatgtgtccctaatccaccgctctcacttgctgtagcgctaatttcctgctctcttattcagacctcttgccagctagagaaatggcaggacactgggccatcttgtaggattaaaaagtgatcaaccatttgccactctgtgaacacaaagacaagtagttctaggggtggatggacaggagctataaatccatatgacttaagctggaatgctgacttggaacctgtgttacacttaaaattaaagataagtgcgtatatcatataaatatgattaatgatagcagaaagtgttagaggaagggaaacaataattatatacaaaaactcatgtgcaggataatacagggttggagaagcaaactgaagtcacttgtaaataaaagagttaaaaatcgtagcacaaaaattggttttataaaagaacagtgttctgcaattgccttgtgatattgaattgtacttgagtaaattaggagtggtgttctcctgtttagctgtcattaaagaactcagtggtaaatgtcagtgtccccaccaagatcccactgagttacgtgaaattctccaaaaacccctccaacaggagaatttataagctctgcatgctcaaccgtcttaatgtgtaaaaccgactgagagatctaagactaactgtatgcagctcaattccaatttgtttgtttttaacaatgtctttgacatgttatacattatgtcacgttccaatttgatgaaaatgtcttcccgtgtccagtaagaaatacgttttaagaagcagaccaactacactgttattttccttgctgttttcgatggcaggcactttgccacatcttctctcttcaaaagatcatttatcaacaacagagttagctcctggtaaaagagtctaacttagactggtgtccttctcatctacccacctctgagagcaaactgaagtgttttgcattttacacaggataaaccacctttaaaaagactgcagcaacattagctccaagaatgatattgcaaagtttgccactattcttttgaagaaaggaaattatcttggctgaagctaaatgccggcagctgcatgccatgttctctgaaaacagcaaatgtcctttagtttagtttatctgtggtctgccttggtgttatccactgttaattcttagtagtacagaacaatccttagaggagcaaagaaacatttattcaatgcaatcagtgaacagagaatggagggaggtgggtgggggataacaggagctggggaggaagaataggaattcttacaaaagtttggagttaggggtcctagtgggattcctcccccttttaacaacaaagtgcagagtgaaagaatatgttcagcttactttgtcttcctgcttcgtttgatctgaaagaacaatcagatacggctgatttctgaagactgttcagaatagagagatctcgaatgccccagtgatagccatcgttgtcaacaggaggcattgcaggcactgacaccagcacctgaaaacgctcagatgctcaacacttcatctttcatttcaaaatctactgctgggaattctctttatacaatgcattggatgataagtatttagagggggactggatcctggaggagaataaagcatggacctcagagactgggattgaacaccggaggaatcagacattttaaagtcagagaaatttctcaaagagagagagagagagagagaaattataaactgctgcagaaagaaagaaaataaagaagttatatccacttagacccaaatctttctttatcttttatcttttttttcttttcttttcttttttttttttttttaagagacaaagtctcttgctccatggcccaggcagtagtgcagtggcatgatcgtggctcactgcagccttgaattcttgggctcaagcgatcctcctgcctgagcctcccaaagtagctgggactacaggcacaccaccatgcccagctaatttttgtagaggcgggttctcactatgttgcccaggctggtctccaactcctggcctcaagtgatccccctgccttcgcctcccaagatgctggaattacaggtgtgagctatagcactgggccccaaatcgttcatttcacctctggctggtcatgtggttctcttcctacctacatgccgactgacctcgtgaggtaatcgcacagtttggcataaacttcaacgtaatgagaagcgtccttcacctcaaaggagtccaagacaaactggaaatccccatggaggatttctgccagaaaactgagcatctttgtaaaccaaataaaggcctcaagtgttgagggatagagcaaatcaatagcatttttaaaaatcagtttttaaaaatatatatgtcattgaccatgttaaatatctaaaagagccatcttatctaaagcaaagaattggatggcatatatagtaaagtcacggaacatgctatgaggcttcaggttttgctaattcttaattaaataagaaagtagcatctttcaaaataattcccatatctttttagccataaaataggcaggatatttggggtgggggggggcaattttttatttttttaggcaagaacacaattccactggaatacatttgattttatctccacatagggtgagttctggggctgtagacagtcgtatggctaccaattaattgcataggagaatcaagagataccatttgcttccatcctagctatgtctctggtggcataaagagtacattttttgaaatgtaaaatttacaaaagcgttaagaagacactaagtttttaggtgatatgttgactccattttgcccagtttagcaacttattacatatatttcataaaatttaggtttggtgtttagattcttgacagtgttacagtaaaactcgccccagagatagaagaaagctcctttatctagaacataaagttcactagcaaatgtgcttttgcaacttttttctttaaagaagagagaactatagtaaaaataataagcagatcctacttctaacacctttatatatctgtgatccaactcttcaattgaataaagaaattaataaatctctaggaaaaaagctgatatttttatcgaatttatttttagtgtttcattccctaagaaattatttaaggttcttaatctgtaattattaaaatgttcctttccctttctgaagggcaacattttaatctctgaagacataaaatattagttaaggtgctctggagtataataaaagcagatgatagaaatttgaaatcagcttttactgtttttgaaggagctaaaacaaagttttgaggaataagtcatagctcgtgtgtgtgtgtgtgtgtgtgtgtgtgtgtgtgtgtttgtggcaagctagagttgactaagcagaaagagatcagaaattgtatccaggatcagatgcccagtgttggggcagaattaaggagaggcggatgtgaagacagcagcaggtcatgctgggatatgcaggtggcatctgctacagtggcaaaggacgaaaactgagaacacagctggttttagaagcaaatacctgcaaccttcttgctacagatacaactttaaccttcagtttatgatctccttgattttcaagaacaagatacatgagtatgctactactatgctggtttccttaagctttgtctcacctttattaaaaagaatattgaaactattatagttttaagaagcacatcatcacctaaaggaaatcagtgtcaaaatttttaatcagtttaccaaaatgcactttcaaagtgcatcacaaattctttttgtgattgtttcttttagatttcaataacatttctaaaacaaatatttaggtaattttacataaaaaaaggaacaaatgttttggtgctctactggaagggaagttccactgaaaatatagatactgcatacaaatgcacccatccatcttgaagacaatattcccaatacaagtactgtggtatttccttaagaatagtctgtggaaccctgtgcagtggctcatgcctgtaatcccaacactttgggaggccaaggcgggaggattgcttgagctcaggagttcaagaccagcctaggcaacatagtgagactctgtctctacaaaaaaaaaaaaaaaaagaaaaaaaaaaaaaagaaaaattcactggacatggtagtgcacacctgtagtcccagctactctggaggctgaggcaggaggatcaattgagcccaggaggtggaggatggggttagccatgattgtgccactgcactccagtctgggtgacagagtaaggtcctgtctcaaaagaaaaaaaaatcctagtctatagaattggccttattaggctgagacctgtaatcccagcactttgggaggtcaaggtgggaggattgtttaagcccaggagtttgagacctgagcaacacaggtagaccccatctctatcgaaagtacaaaaatcagcagggtggtggtacacatctgtagtcccggctactcaggaagctgaggtggaaggatcgcttaagtccaggagtttgaggttacagtgagccatgactgcaccactgccctccagcctgggtaacagagtgagactctgtatctaaaagtaaataaataaataaaagtagtctatggcagcagtccccaacctttttggcaccagggaccaatttcatggaagaccatttctccatggatggcagacgctggtggatggggtatggtttcaggttgaaactgttctatctcagatcatcaggcattagattctcataaggagcatgcaaccgagatcccttccatgcacagttcacaataggattcacgcttctgtgaaaacctaatgtgccgctgatccgacaggaggcagagctcaggcagtaatactcactggcccaacactcacctcctgctgtgtggcccagttgctaacaagtcacgggcccatacaagttcacagcccagacattgaagacccccggtctatgggttacctagaaccatcacctaaacagattttctatagcaaataccaatttaaaagttcaacttgtaatacacacacacacatacagaaacataaactgaggatgaattttgaaataccttaaaactaagaatgctaattacataattgcgggtataaaccaaaatgaatgtttctgatggccacttgttataggattaaagtctgcaaacaatgatttgaaatattataaaaactaggaagcatatgttctctaggcaggtatatgcattccccagctatgtggcactcgtaatatatgatattgaaacttacttgttagctctctatttgggggccaaatatctcaatatgtcacctgtctcagaaagttcaggatgtggttcagatggtgtctgtcaggtgaaattcaccagatgaggttgcacatacgtgattcagttgtcatttctatgacatgcctttactggggttgttctgagttgctggtgggaactctttcaaggagagcagggggcccgtttgagatggtgttgctgttgaattttgtcctttcacttatctcagcctcttctagcgctttgcacagatttcaaattgcaactggcgaggaagtgggctcccagtgaaaaacaatgacctacataaggtagtcatttcagcagagttcgcatgactttgggtcagatggcactcactccatctagctgcttgcttttctatcttgttgcacttctgctgtcagtcacttaaaaataaaaactgcaaagttactgaaaaggcatctaagttacttttttttctggcctgtcactttagaccgtgtgtgaatttcatacatcagttttgattaccctcagtgctgaacaagaggttctattgtaatccatgatgagggtcttaatattatcccctcctccgaaactttataaaatgctccccaacataccctcatatatatttacgtggtaattggcatggggttatgcaaaatcagtgggaactgccttacttacaattaagcgtcacacaaagtaaaaaattaaaattaaagtgctgggcgtggctgctcacgcccgtaatcccagcactttgggagaccgagatgggaggatcccttgggccaaggagttggaggccagcctgggcatcacagggagacaccatctctacaaaaaaaaaattaaaaatttgccagtgttggtgtcgtgcgctttgtagttccagatagttgggaagatgaagcaggaggaccacctgagcctgggagactgcagtgagccatcattgcacccctgcactccagcctgggtgacagagctggaccctgtctcaaacaaattaaaaaattagaaaattaaaaattaaatatttgcattgttggagctttttacttttttgacaatttctaacataaggaggatgtccttatgttagattgagcttaagtgtctggttatattatatgtatttcacaaaatgcaagttagcctgagagtctagcatagattaagagatgcaatcaaacacacgctggtagtactggtgaagcagattaaacaggtaacccctgaaatgtgtacccaagaatatgtttagtttttagaaattgtcaacaaagtgaaaagctccaactatgcaaagaggacaagccctacctttgtaaacaagacacctttacaattgtgtatttgtgtatacaggttgaagatttggccagtagcatccgtgtcaaaataaaatagtgaaatgtccatatcttctcaatttcagcgataaaatccatcaatgcgtctccacattgattctttgctaatgacattggtttaaagattatcttgtttatttttcacatgatgactgaaatatctatgcatggtattacttttatatgtaaagttataccgtgttgacagattttgtagtcttttatatgacaaggcagtatgaaacaaaacctttccatgactaccaaagaaagcaatggggttaaatgacagagctttcctaactatttgtctgtcatagagaacagtaaattgcagcctgtctcaaggttggtgtttagacacattctcagattaacggttttgcatagacactttggactccaagtggttttgagatgagctccatcaagaatatcctctggcctaaactaagcagagggttttgagaagtttagtatgaactctgtgaaaggaaatttgattgttaaacagactatatcgatatggctctccttgtctttaaaaaatgaagaaaggtttttagctaaatctatagtaactggtcccattaatgtcttacttttacaactccagagcagagagttatgttgttttccacagaatgtttcaacaagactgtgcttttgtacttaaagaagcagatatccaaagaaacttttgatatgataaatgaacaatcacaaagaaaaagttagttaagtagtatgagtcacatgagaaaacaactcagctaagaatgtgctgattcattcattttcaataacatcagtttatttttagtgctgcactgtaatctgataggtgttcctacagctggtgaatttgaaaccttaaaggtgatgaactgaatattgaaatatgcagaagtcccacaaaggaaaaagtgcatagtagtttatgcttgcatttttagcagttatgctgactacttctgtaaattaatttgtctatatggacctatcatgaaactcaggagaataagaggcttaaaagtaacagatttgcatacagtaatttcttttccctttagtctcaatgttggttcacgtaagcacttggataaaagtaagttttagcacttagtactttaagcactttagtcgcatgtcaaaattaggaatattgtcctaatgttcaacctgtttattcaagtgctcccaaaacatcgaagtattacatttagaaaaagaccttggacataaaatccaatcttataaataaccttaacaaacaaatctatataacaaattttttcccctggcaggtaatctataagaattatagaacaaataattattgaacaactattgtgagcaagatattgtgctagacagggtcagagatacaagaagcgttagacatggtttctgccctccttggtgctatcactgaattagtagtgtgaggattagaactataaaaagaaaaatgccagccacagacagaaaacatgtgctctcctatgtgaattcaaatgaagactcttccaggccagagtattaggaatattagtcacagaaaagcaggagaagaaagtgaaggaaggcattcatggagttggcatttgggatagaatgcaggaacagatgatatggagacaggaaagtaaaggcaaaatccagaccaatacctaaaagcacgggcttgaagaccaaacagacctgggttcaaatccttcccctgccgtttgccagttatatgttttatttgccttctctagcctcagtctcctcaaccgtgtaatacctttcttgttgggcattgtaaaatttaaatgagataatgcatggaaagtaatttgtattaccgattaaaaaaaaaaaaaggtaaaagaaggatccaatttgacttcacatagagaagtcatggaaaatgaatctaaaaagttgtggatgacccctgaaagctaaactaagaaatttgggctgggcgcggtggctcacgcctgtaatcccagcactttgggaggctgagaagggcggatcacgaggtcaggagatccagatcatcctggctaacatggtgaaaccccgtctctactaaaaatacaaaaaattagccgggcgtggtggcgggcgcctgtagtcccagctactctactcgggaggctgaggcaggagaatggcgtgaacccgggaggcggagcttgcagtgagccgagatcgcaccactgctccagcctgggcaacagagcgagactttgtctcaaaaaaaaaaagaaatttgacttcattgagtaaccaatggggacccattcaaaatggttaaatcaagaagagatgtcatgaaagcagggcttagaaaacctagtgagtgtgcagggtgcagttgcttgccccggggagagactgggaaaaggaagccactgcggctgagcagacacgaagtgaagagggtctgacatgggcatagaaacgaggacacaacaggagtgttcgggaaagaaaatagtgctttgttcatttgattgtagctaactccctacaaaattccttccacccacacaaggctgtctctacatattatttgtgtaacagtcactgcagaaaaacaaaaacagaactttgatggtgctcttttggatgacacctggttgcaaatgattgtattagtcattctcacattgctataaagaaatacctgaaatagaataatttctttcttttttttttttttttcgagaccaagtcttgctctgttgcccaggctggagtgcagtggtgcaatctcagctcacctcaaccaccacctccagagttcaagcgattctcctgcctcagcctcctgagaagctgggactataggcatgtggcaccatgcctatctaattgttgtattttttgcagagatgggctttcaccatgttggccaggctggtctcaaactcctgacctcaagtgatctgcccacctcggccacccacagtgctgggattacaggcgtgagccaccaagcccggcaaaaccggataatttataaagaaaagaggtttaattggatcaccgttgcacgtgttgtgcaggaagcatggctggggaggcctggggaaactcacagtcacggcagaaggccaagggggagcacgcgcgtcacgtggctggagcaggaggaagagagcaaagataagggaggaggtgctacacacttttaaacagccagatcttgtgagaactcactcattatcgcgagaacagcaagggggaaatccgcccccgtaatccaatcacctcccacccggcccctcctctaacattaaggattacaattcgacctgagatttgggcagagacacacatagaaagcacatcagttataaacgggaacttccctccagtttccttccatgggtttctcccttcatcacacacatccatgttcctctgaaacgaaatactgacaacaagattctgtggctgacaggaggaccaagcgggacacatcttagcctttttgtctgaatcttgttaccaaaccatttttctcaccagcgaattccctcataaggaaggtgggcttcagcgctgctagctaggactgtgatcccagcaatatgcttttggctgttgttaacagtgcagctgcaaacactggtgtgcaagtatatgcctgagtacctgttttctgtttcggggatatacacctaggagtctaattgctgggtcatatagtaactctacgtttaactttttgatgaacagctgaacgatttttcacagcaactagttttacgttcccaccagcaatgcacaagggttccaatttctctacgtccacaccaacactttttccccatttctaatattccaaccatcccactgagtataaggtgattctccttttggttttcatttgcatttttctaacacctgatgacgtcaaccttttttttatgcgcttgttgaccatttatacaccctctgggagaaatgtctactcaagtcaactcaaatgttttcatgtgtgtaatgtacttagcatactgcaaagaaaatactcagtctgtaaatactaactagtgataatgatgtcaataacaacaacaacgataaggagatttggacaatggtctgggttccgccacagcctcgatgtgtggctttaatcaagtccattagggaacgaatttaagaatggaggctaaaaaaattcttgattctctaaggctcttttaaattttatttatttatttttgcacaacttaaagtaagaattatggtaaaaaaaaaatatatatatatatatatatataagcttgggccaggcgcggtggctcatgcctataatcccagcactttcggaggccaaggcgggcggatcacaaggtcaggagatcgagaccgtcctggctaacaccatgaaaccccgtctccactaaaaatacaaaaaaattagccgggcgtggtggcaggcgcctgtagtcccagctactcgggaggctgaggcaggagaatggcgtgaacccgggaggcggagcttgcagtgagccgagatcgcaccgctgcactccagcctgggcgacagagcgagactccatctcaaatatatatatataagtttgaacacagaggacacattagcagatgccaggccacacttttcagtgacactttgatatcccctttcactgaccatggctctgccaggacctactgtggatacctctgttctgggagcctccttatctccagccagtccgagggtcctttctgtctttccccctctatctgccatccttcctttacatttgctgcccttaggatctgaacagaaggagagtaagacttcagggatgagaggccggcagcattccctcctttcaggaacttttagagctattaccttatctcttcattgttgagtgatgctgaaatacaactgcagaaactagatatgacatctatggcagggacacatctcagacgaacggagtgttcatgaaaggacctgatagtgttccgctgcatgaaacttcagcagcttattcatggccgtaaacgagtttctccccaaaccccatcattcggggttcagtgcacctgactgaaggctacaaagacattactgcgtgtatttagtgtgagtttgaggccaaaataaaaaggtaatatggcattatcatcaactcacaatgtgcctgaccgaggctttgggagacacaacccaaagtaataattaaaaaataatcttcctgtcgattttaaatcctaggagctgcaaaggatagaggaaaccccaagtgggcttttaagagctctaagttacctgaagaaacctagtttctgcctcctgagatggagctgactctctcttgctggaatattggtgatttctccaaggcccttcatatgtggagggactcccttgctctgctcagggattaaccattcttggtctctgcagtataggatgatttcaatctacttactttaaaacatgttttaattatgttgaaaaagtttgtgttaccattaactggcagtctgatttctctatcgaggctttttcagggtcattttttttttccagtgcagtcacattatcgtgattttagctgtaattgtttgcattgcattagtggattgtggctgccaggaaagagaactagcgatttctggaatgccttctacataaggcaccatgctgggtataccattcatgagacaattccttaaaactggcagtgatgttagccccaatttagacagatgttgagactcagagagttccgatagttctgtagttgatgggtggcagagtgatgatttgaatgttacctctgtctaaccccaaagcctatgtttgttccaccaaaccctttgcggatagaataaggcacctttttaatggatttggagccaggagagtgagcagggcaaagacatccatatttgcgcttcccatttatacaatggttgcaaaattatgggtttgaggatggcagtgggaagtttgtaagaagcttcccattcttgcaaataatgaggatacagaatctttattttttaaagttaaaaaaacaaatgctacctccatgtggagtttcagtatgaatcacattaaaaaaaaaccaaaaccctacattgctactactaagcaataaacatcttttggttcctaagatgagaaatgaggaaaggttttcattatagcaattaaactgtcttaatgcaaatgaaatatgaaaaaaaagcaagaaatgtattatttttcctgcttgatgaaaacagcttccagaattatatcataaaagaatatttaattaacttttaaataagaagatgaacctttcctttttattgtaatttccctaaaatattttggtaataggtcttacccacacatgtacataagaatgttgtaaataaaaacatatttctggtgatgcatattaatgaaccctacaaaatatttgagtaatctctaaacatgaagaattttggtagtgaaaaatgaataaacgcattaatgatcaagattaaaacttaatgataatcattatctatgagtacaaacattaaaaatgagcattctaaatatcctaaaataaaggtaaatcaatacaaattaataggtgttagattttagagaagcttccacatggaaaatagattttaaaaattagaagaatatgatagaaaaaagcataacaaaatgaaataaaacacaatattagaaaatctcagcttgtgattcagtgcaagaaaaagaaaaaaaccttcatgagtgaaattgaaagtgataaaactaactagttccatgccagtaatagacccagtaataagcaaagtaaaaactgaatttaaagaatttgcagaggtaactctgaaaaaagagaataataaacaaggcagccaaagcataatttgtttcatggagagctgaatattcctatttcctttctggcattaaaatatcagcattccatggtacagtattttgatgttatattacattgttttgtatcataacatcatgaaataaattcaacattttcagtaccctcttccttgggcctcattttgctcactgtaattagaagagatgagcaggaaggacttgatcagaaccaaatttccagaaattccttctagcccccttctaccatatatcactgatgcttccttgttgggcccctcaactagaatatgcaccccatttttatttatttgcccctttgtcagatttagtcttgtgttcaaaccctttattttcaaaattctgcaggtgtgttatacaccaagtaaatgtcagtgctttcttcttattaccaaacctgggacatccctcaggaaaatacatacatagatgcataaacacacacacacacacacacacacacacaaatacactcttgcacacacaagagatcagagaatcaggtcatgacagctctccctctgctcagaaatcttgacagggcttctaactctctaaattccagacactaaggctacagatgaagggaggagtttctgtcccctcttcttcaaggtaaggacagccagttaaacaggctgttgtaatgcaaggcattataatactacagcatgatatttaggatcattgacatcaaactgggatgtcagggaaagcttcccagaggtcatacttgaggtgattattaaataagagtttgtaaagagaagaaggaagttaagaatgtttctaggcagaggctgcagactgtgtggagatacagaggcatgacaagccccagtatattatgagtctgcaagaaattccaggtgtctgaatttctgagtggaggcacaggtgggggaaggccatagctgtgggtagggacgatgtaccattagttatgctcatgtccatctccccaccttgattctaagtgctttatgcatagaaaaagcatcttacttatttttgcatagttccgcagcctcagctaatgccttacaaatagaaggttttgaattgaagatttaagaatacacatataggctgggtgcagtggctcacacctgtaatcccagccctttgggaggccaaggtgggtggatcactcgaggtcgggagttcaagaccaccctggccaacataataaagcccatctttactaaaaatacaaaattagttgggtgtagcggcacacgcctataatcccagctacttgggagggtgaggcaggaaaatagcttgaacctgggaggtggaggatgcagtgagctgaaattgcgccgctgcactgtagcctgggtgacagagtgagactctgtgtcaaaaaagcagaatacacatatacacagaagaaaaacatagaatgggagagtaaagcagtgacagatgagtcagtcatacaaaaatctaagaagccaggttaataaaaggtagcagattttcaattacttatttctctgaattccaatgattgagaagtgtactgtctgaaagatgactcaggctgtagacagaggtacagatattccacaacatcctcacttgctacaatttgggggtacctttcctctatgtctaactcctggttccttcagagcaattttccattcattgcttctgttgacattgctctcttcctcttccaaggacttgaacttcaggactccttttacctccattccagccaatgcactaacttccctcttgaggatgagcccagaaacctcaggacccactttcaaagccatctccagctactgacgcttgaattaagcaaagtgttggtccctttttcccaagaagaacaaaaacttacttcacaaaaataaattcaggaagagcatactatttcaagactatggatatattcatatagatggatgttttattttccaaataagttcttatttgagccagtgcctgacacattgcttcgtaaactcacactagagcttggagtttatggattatctcaggaatggcttgagacatctccaaatgtgaacaattataattattccaatatctgctcagctacctccaggatcctgcctaattacacatttttcttgcagattcaaagtgtgcttagttcttctttcccattcccattatttagacttaaatcatgatatttcttttcttttttcttttcttttttttttttttgagatggaatcttgctcattcgcccatgctggagtgcagtggcgcgatctcggctcgctgcaacctccatctcccgggttcaagcaattctcctgcctcagcctcccaagcagctgggattacaggtgcctgccaccacaccacatattagttttgtacatatttgggggtacatgtgataatctgatgcatttatataatcaagtgagagtaattgagatatatagcaccttaaatatttatcttttctttatgctatgaacattcgaattgttctctcctagctattttgaaatgtacaatagattaatgtcaacgatagtcaccctactgatctgtcgaacaccagggatggttcttaatcacttctcttttttggccaattactgtacttcagggccttttaaatgtgattttatggctacagaaacctaacatcatattcaaaagattctttaaagtgatctaaaaaccaaaaccaaaacaaaacaaaacaaaaaaaacactaacctttgagcctatgccaacacattgcggagaaatgttcttatttgttaggggtttgtttcagtaaaaatgacagataatgccatcactgtctgatcacccatacatggcttgaagccatttctggctgcccagttgtcttgtctttctacctttccttgcatgatgataatccttactgcttaactgccttgtgggatacttttcaactatcaaggactatctggagtattttttcactctcacccatacagatactagctctccagtatttcttctaggaaacaatagcatagacattgttcatgaaatcaagcattaggtctccactgcactcataatctggctgctcttttcagtagggtggacaccggcagtcagtgctgactcatagggtacactgtagtagtaagcaatgtctaacctaaaactaaccctgccaacaccttgagcttggacttccagcctccaaagggtaggcagtgaacagcagctctctatccaatcaattttgctttacctcaaaaccttagctaattcttgaaaccaaataaatttctaattattgataataaagtatttgaaacaatatttaaagaaatatatacttccactctaggcataatcagatatcttgcatagtaaacctcaaagttatcaactgctgcttaatctttttctcatcaaacgtatcatgaggcctgaacagcttcttaaggtgacacattctttgggttgtatttgtggctctgggtagggctttgcaatggcctgggaacttgatgaaagactttttgtgtgtcatctcattttcctccatctcatcttcatgccaatcctctaagataggtgccgtggactgagttgtgctccccaaaatttgcattttgaagccctaacccccaacatgacagtatttggaaatagggcctttaggaatgtaattaaggtgaaatgagattataagggtgaagccctaatccaataggactggtgttcttgtaggtaaaagaagagacaccagaggcccaaaggtcaggccatgtgtattaatctgttctcacactgctataaagaaatacttgagactgggtaatttatataaagaaaaggggtttgactgattcacagttctgcatggctggagaggcctctggaaacttacaatcatggcaggaggcgaagcagaagcaggcaccctcttcacaaggcagcaggagagagtgagtgcaagcaagcaggggaaatgccaggtgcttaaaccatcagatcttgtgagaactcactcactatcatgagaacagcatgggggaaaccagccccgtgatccatcacttcccactgggtccctcccacaacatgtggggattatggggattacaattcaagatgaaatttgggtggggacacagccaaaccatatcactatgtgaggacacagagaacaggtggccatctgcaagctggggaaagagccctgaccagaaactaaccctgccaacaccttgagtttggacttccagccttcagaactgtgagaaaatacatttctgttgtttacgccatccagtctgtggtgttttgttatggcagcccaagcaaacgaatacaaaaggtgttggcctcatgtagcaagagaggaaaccaaaaggcagaggactgagttaaatcaccatgaggttgaagagctcaaaaaatagggaccttagtctgtccgaagtcaaaatccacacttttttccacttcatcacacaggttctctgtgtaactactcagtcttgccccatctcagtccttaccccagggagaaattgggcctttcagcaacttcttggtccaggaaatttggctcaggcatcatgaaaacccaaattccctatggacaatgcagctccaccatccctctctttgttcacagaattggcacaaaagcacctcaagatcatctactttaaccccttcactttgcagacaaggcaggaagaagttaagtttgtggctggccttttccaaataggataagattttcctctgaattttcgatactcaatagctcagaaatgttataatatgcattttaaccaataatataaattagttattaagtcatctggcagggtcccagctctgttataggctgcttttgacacagaattatggctaaactgctttacaagggccaaatcattttcctcgaaacataaaacacatgtaaccagatcacatccaggctttataaacagacgtgtgtctgtaccacttgctcagcagaatccactgtgggctctgctgcctgtttatggagctgtgggtgcatcagcaggaagcagtgtcccaggcagggtagtgggaggcaccctagcccagcaggagtggcaatagatgaactgtcattttatagcatctacctgcctttgactcacacatcaccaagagtcaaaacgcattgaaacctatttttaacagccaggcaaagggagaaagacttgtggaaggaatttaaagtcttctcttgagaatgtaacacaagctaccctctaaaactttcttgggagaaagagtttttgtttgaaggagaattaaaactcaaactccgctgaaaagcacaaacaaaagctattgttgcttaagcaagaaagaaagatggaaactacaagattaagaaatgaggcggtgtggggcagcagtggggtcagaatgtttggtttgcaggtaagatgtggtctgcgagaaattaatgagggaggaaagagagaaagatgtcacaatagaattaaatcagaggtcatgtcctcaggcagatgttcacaagatctatcacactccaattaagagtctacaacacaaaaacaaacgtggtgcttaaaaatgaaggaggtggatcttcagaaaacttcaaaaagaatagtcagtggctaagagatcagggcaggacaagaaaggtgaatgtgttggctcccatccaattaaggactgtttcaaattttatgtccagattatggcataagaggctgcaaattccagtgtccacgggggttatgttacacggttacagatggccagagtggcgcctgatggggccaactccacaccgcatggctcagctccaacccattgttaccatgcaagaagcaggcccagtactgccagagactgtgatttttctcagacgtggcagagtggcagaaatctagatttgtatgtaaaacagtggacacttgttttttttcttttttttttttttttgagatggagtctcgctctgccgcccaggctggagtgcagtgatgcagtctccgctcactgcaacctctgcctcctgggttcaagtgattctcctgcctcagcctcctgagtagctgggactacaggcacatgtcaccacaccctgctaattttttgtattttcagtagagacggggtttcaccatgttggccaggatggtctcgatctcctgacctagtgatccacccgccttggcctcccaaagtgctgggattacaggtatgagccaccacgctcagccgacagttggtttttaataatcttcaaacaccttgtggacaaagcaagacctgtctgtaggctaatttgctctcaactctccaacttcttctgtcttcttcaagagatggcctctgtggttccccggattttctcccaatccatatcatcagactcagaatcaaaacatgcgttccttttcttctgtcattgctctggacaagagccatcaacatctccccatggccttcttggtgaatttcaaatgtttcagccctgcactcaaggctctgcatagtgcctgccgtctcactctacaaagtttcatcgtgtgcttcccaacgggaacctgtggcccagactggaaattttatgcattttcccctcaaataaaatctgtacattcctgcagtctcaccttagttcttcatatatcttctatccttttctttttaagaggtagtgacttattctgttgcccaggctggagcacagtggtgtgatcatagctcactgtagctgtgaactcctgggctcaagcaatcctcccacctcagcttcctaagtagctgggaatacagatgtgtgacacaatgcctaatttttttatttttttatagagatgaggtctcactatgttgcccaggctggtctcgaactcgtggcctcacacaatcaaagtgctgggattataggcatgagccaccatgcccagcctctttctccttcttcttcttcttttttttttttttttttttgagacagagtcttgctctgttgccaggttggcatgatcttggctcactgcaacctccgcctcctgggttcaagcgattctcttgcctcagcctcccagtagctgggattacaggtgcccaccaccacgcccagcttatttttgtatttttagtagagacggggtttcaccatgttggccaggacggtctcgatcacttgacctcgtgatccacctgcctcggcctcccaaagcgctgggattacaggcgtgagccgccactcccagcctctttctccttctttataatcaaattccagtgaccacctgatccttcaagacatcactcacatatcctttcttctgggctcgttgtgctgcatgttctcttctaccactcttctatgaagcttctgacatgtctcttctaaacacgtatctcttaattttgggggctgtatggctgtttcctccacacaaccctgagagtttaactcagggattggcaaacctttttggtaaagggccaaacaagaaagacttttggctttgtgggccctgtgatctctgtggcaactactcatctgctgaaaagcagccgtagacgagatgtaagcacataggcacggccatgttcccatacagcgctttataaacacaggtgaccgcatctggcctggaaagcacagtttgccaacctcttgccctgcttggacaaggacagagtcttcttgctattattatataatagataataaatgttcattagaggataaatccctcaaaactcaattcaacttgatttcttccataacctttccttgacagtcacggacacagcagcattttccaacttccgaacatcttcaagtacttggtatccaggtatctcctcatatgactcttgccatcattgtgtgatattcacttcatgctgctgtgatgaattagggttgatctatatcatttccagagtcttttgttctaaaatcctatgggtcagttcattgtcttgtactgccaccgacttgtatatttttgggttttctccacttcaaataaattataagcttctagagaataagccatatctaatttttcttgggattgctaaaatgctttatatagtgcttttgtcacaatattcattcatttattcatgtaacactgtttgtgggatgatatgtagcacaaacataaaaataagcaaaatggaaatggcccctgcttcagctgaagtcaaagtctagtgaactaatgattgtatcatcataaattgagatgtactttctgaaagaaagtacataatttttaaacaacattgcacaaagaaagcaaacaaatactggggcaggtagaggaaggaagggcaggaaggacttccctgaggaagtaatgcttgaatcaagatccatttattcaaccaattcagtacatattatttgccaggcattattctaagcacttggaatatagtggcaatctaagcagacagaggttcctgccttggtggagcttgttttctaatgggagctgaagagtaagtaaaaattagattgaaaggaaaaaggggttgaataacatttctgaaagaaggaactgcatgtacaaggatcctgggtgggagggggcgtggcaccatccttgcagtggcccgtcccactgtggatgggggcttgttgaggtgtgacctcataggtaatgtaaccatataatttattctctaaagcagaacactcttgacagtaaatgaggcattatgaatcattacaacaagcaaaaactggtatcgttccagcatattggatatatgagcctgggcaaggtagcaagacctcatcacaactaacaacaaaaataaatacataaataaataaaccagcccatgcctgtagtcccagctacttgggagtctgaggtgggaggatcacttgagcccaggagtttgaggctgcagtaagcagtgattgtggcactgcactctagtctaggtgacagagcaagaccctgtctcaaaaaataaacgaaacagccgggtgcagtggctcacacctttaatcccagcactttaggaggctgaggcggctggatcatgaggtcaggagatcaagaccatcttggccaacatggtgaaaccctgtctctactaaaatgcaaaaaattagccgggcgtggtggtgtgcacctttagtcccagctacttgggaggctgaggcaggggaatcgcttgaacctgggaggtggagattgcagtgagctgagatcatgccactgcactccatcctggacaacagagcgagactctgcctcaaaaacaaaacaaaaacaaaaaaacaaaactggacatccgagtatcctactcaggccacataaagattttaacgtgaccacattgatactttttaaaacaatccttctcactgctgtggaaaactgatttggggaggaactgtgtcagtgtgaagaggccagttgctatgctactgcagacatccaagtaatagagcagtgtggcctgagctgggggtggggagcagaggaaatagagagagagaggggaataatatttagaggtatttcagaagcaattttaacaggacttgggtgatattattagtggtggaaatgaatggaagaaagcatggggtgaagtagaatgggaaggtcatgttggaaggaagagagagtttacatattcaggtgcccagacctactcttggcaccagccactaagcctgggagtattttgagagctggtcttaatgaatctgaagattgcagctaacaccacaatttccattagtgataattagtaagagtgtaactgaggctttgacatgggaaagaggttgatagagcaaagtactccccaatggacaatgagtaataatttgtgcttttgtcaaaattgctggtggactttgtgtacttttagggaagcagaggttttcatggtggagggtagcttgatattgaaaattcaatattaggtgctagaataccagagtcaagagtaaagagttggctgggtgtggtggctcatgcctgtaatcctagcactttgggaggccgaggcgggcagatcatgaggtcaggagatcgagaccatcctggctaacacggtgaaaccctgtctctactaaaaatacaaaaaattagccgggcgcagtggcgggtgcctgtagtcccagctactcaggaggctgaggccagagaatggcgtgaacccaggaggcagagcttgcagtgagctgagattgtgccactgcactccagcctgggtgacagagcaagagaaaaaaaaaagagtaaagagttataggaagtgacaaccagaccaacaaataagagcaagagccgtgatttgtggacattgatgtttcagagagatgtttagctgaaataagcaaccaggactatatctggaagctgagtttaatacataattcagaaaccaccttaactcactgctttagttttaaatgagatgttgaaattgttgtccagcagtagtgcagagctgactcctcatcagtcatttctctggccagcacgtgctgcccaggtgggagaatttcgtttcgttctgagagctttcagtcaatccgattgcatctgaccgggaaggtctcagtaaagatgtcacttcaccttttaccctcaggctgagtcagcgaggaaagcaaaagaaactgagtggccaaagctctcgactacatgtcaagaatcctttgccccttcctcccacagcttcacgcaacttcactgttagccaattattgtacccctttacttaggagtacccagttacagaattgttagatgtaaaacaatccactcgtcttaaccatgcagagatactgaagaaggaaaaggagcttgaatagtgagctctttgtgtgtgcatctgttcttgcaatatgctgatcctcgatcacctctgcctaacccacgtttcaaaactctttgcaagtaaggatgtggaaatagttccacctgaggccagatgtgaaattcaggttgggacttggagctgtaaaatatcgtaccttgacttctttcaaaatcaaaatattcaattacacagccattaaaaaagatgttatagaaatatgtttcaagacattggaagatattcatgagaaattattaaatcaaatactagattataaaagaatgtgctcagtataattcaatttctatttttaaaacaggtgtagaaaggacttgagtgtaaagtaaaatcttaaaagtagtgacctctaggtagtgaaactagtaaaaatttttattttctatgtttagattaacaatattgtttaaattgttcagtaacaggtactacttgtgttataaaaatgtatgtacttctaaatgtactatccaacattcataaacgtgcatggaagccacactatattatcatccatccagtgaaacagggatataacctggccgctctcgtgtaatgacagaacattcaattcaaagttgggcaggcccagcatggtggctcgcgcccgtaatcccagcagtgtgggaggcaaaggcaggaggatcacctgagcccaggggttcacgacaagcctaggcaacatagggagaccccgcctttataaaaaattaaaaattggctgggcgtagcgacatgcgcttgttgtcccagctactcaggaggttgaagcaggaggattgcttgagtcccgggtgtcagggcctcagtgagccatgatgacaccactgcactccagcctgggtgacagagcaacaccctgtctcaaaaaaaaacaaagacgactaagtatcgctgccttgctttgccccctttggtaatttaggagacttcactgtgcctcagctgtcccatttgtaaaacaagattcataatggttgttaattctaaagttgtaagaatagatgaaaaaaatgcttacaaattgcttaacatagagtaagctcctgaaaaatattagttaatcttatgattacttaggtaatactcttcttgaataggtgccaagaagtttccagaattgagtgttgtattttgtgggcaccaagtgcttcaaagaaggatgtctcaggccaggtgtggtggctcacacctgtcacacctgtaatcccagcactttggaaggccgaggcgggtggatcacaaggtcaggagttcgagaccagcctggccaatatggtgaaacctcatctctactaaaactataaaaattagctgggcgtggtggcacgtgcctgtagtcccagctactcgggaggctgaggcagaagaatcgcttaaacccgggaggcggagattgcagtgagctgagatcatgccactgcactccagcctgggcgacagagtgaggctctgcctcaaaaaaaaaaaaaaaaaaaaaagaagaagaagaagaagaaggctgtctctggtcaaggccaatgccaagcacactgcagaagcagtggttttatgggaaactgttagagaaaaccattagccagaggggctgacatttcctgtcccttgcaagcagttatcctacagcatacctgatacttttaagtgacttggctccccgtagattcttgatccatccaacgcagaaattctagcactgaacctaggcgaaaaaaaaaatgttactattcctgtgtcttttaggttactctgggcactgaactgaggcttttgtgtatggagtgaccagataacttcaaggatggtaattgatgataccaaaaccctattgacagagtcattttattggaactaaagagagtttggggtagatatatatttggggaacataattttacttgcttagggttatttaaacatatacaaaagtagagggaatattgtaattgccttagttcattcaagctgctacaacaaaatactacaaactgggtgacttataaacaacagaaattcatctctcatagttgtggaggctgggaagtccaagatcaaggtgccagcagattcagcttctggtgagggcctgctttcttgttcgtaggtggcaccttctctccatgtcctcacatggcagaaagagcaaggcagctctctaggatctcttttataagggtactaattccattcatgactccatcctcatgacctaatcacccccgccaaaggccccacctcttaataccatcatcttgggagtcagaatttctacatatgaattttcagggacacaaacattcagaccatagcaataatgtacattcatgtactcaccacccagctttcgcaattatcaacacacatacaatattgaaaaacacatatattaattgaaaatttcaaagcacaattatatgatttgcccctttagttatctgagctgagaaagcatgggagaagtatctgagcttagcccacttggccaaatcttgcttttgacctcagctgaaacagaagagctgctaccttcctattgtaatacagacagttcctaaatgctgacagtgataaccaccaaatacaaaacaataagatgggaacatgatgccacgtgtgttttcaataccaaaggtatctacgagcctagtgtttcaagaaatgctaaagtgtgcatgtctatgaatatgtagtacgcaatccacttcgttctgcctactctgaacggcctttattaaggggtattttatgtggattctgtgtgatagagaaaaacgtgccactccttggcaacataatatactagaccagttctctttttttgagatgtcaaatatctactttattatagtgagaaagtgacagtcaatttaaatcaaaatttatggggaacattagtagctggaaggactttggctaatcactgtaatgtccccaacaaatggtaaatgaaagcataaggaaattgagttaacacaagttaaaagttcacatacttaaggaattatattagaagacctacaacttaattaaattatctgaaactgctcatttaacttctattgtactagtgaacatttatgcaattttactgttagatatgtattaagtaataggtttggattgggtcaaattgggagaaccctaatgaggcagaacaggggaaagtttaatccatcataaagcatcattcggaatctttatattgaatattattaggcagacatttccctggttagctggttactctcttatatctatcattctgacattttgaataattgaaaaatcaaacaggaactctgtacatggaaaaaataatctgatggagaagaaatgtgttattgatcacctaattttttattttttttcagtcttgcatttgctttttcaactgtagaagtgcaagaagtggtaaatgtgccgcattttagacgttaaaggcattgttaacagatttgacacaaaagataatgttatgagatgcaaacgacagaaatttacatgtcaaatcacatacttaatatttatttctttgttctgaatacatttaaagtcagtaagttcttaaacctgaggtcttaagctatagaattgtttctttcaaaatactttttaatatacagggcagggtattcagtaactgcatatacgtggcactcgtctctttatggctattgacttaagctttttgagaagagttggtctccataactgaggtttgccacaaattacacatgtatggactctccctggggagatctgtaggaaatccagaatggagctgtgctctcttacagagaaccccaaagcagctgtgaagctttcactgcagttgaaaaaaaaaagtgacctttaattcagtccttagaaaacaatttagatgtcaaagtgtaattttctaaagccataagacctttgggaaaattctgccattttttttctcttctgatggaactatattgaaaaaaataaattatttgccgtgatacttggtaacatacacgcacacactaagaaatgagtaagaaaaaatatggcctcccgcagactcgtttctagctgcttgctggggggaaaaaataagctgcctcctctccactgcatttagagaattaattctcatatgaaatgaaaggtcccgtccaatcctatttcacggtagctttgagtgcttgactgtaccaaagcaaagggcattacttgattgttcactgttgacatcactttacaccagaaggtggcaattattttaataatcacactaacaaatctgttttgccttcagattggatttttagagatagtgttcatttgattcttgtcaagaagatgcctttgagaaccagtagcattcacttacagatttatttctcaagttggtttttcactcccactaattggctaaaatattgcacctcttttagaatataagctacaaaatttatatatttctctttattgaaccttacttgttgacctgaaacaattaaaaggatgctatttaagatgacaacacagatgaagtgatatcatgatagagtataagtagatgctgactatcattaaaaaatgaagaatgtacttaatttttatttacaaggaaaactggtgacgaatttcttcagttgaccatgacatcttagaaatgtagtggattaataagatttatgtggatacataatgaaaaatctttcatgtataaatcacaaggcatttatatctaacttacctcacaaggtggcaaaatcccataaattcctccattaaacctgagtggaagataatagccttcttgaagcccagcagttcacagaaagcctatcacccttctgaaccgtatgacaaaatgcagagaaacatccaaaataccaatacactggaactgcctgagaatgcgtctcctaagacaattttccaaaatctgtcatctgaacgctgtttgccatccataaagaaagaggaagaggaaggggaggtagagaataatgttggctctgtgaaaccgcagcattctttccagatggtctcttttttccacagcttaggttacctacatgacaaaaggataagaggccaggggtgagcactctttttttgtaaaactgagaactccagacatttgtcatccagaaaaaatgcctgcttctcagcaggatagatttttaaaaatttttctcagtgcctttctctaattgggcttcctcaacttttcacacatccttgccctgaaccagtccacaaaagccaaagttctcccacacctagtcaccaatggcaggcccataaatcacaagaaattacacacgatttttttttaacattatgcaattaacgcctataatgtgggaaaacattttataatatataacatattaaagcaataggaaatagcatgtcagatttctcattagtaaattctaataatggctaacataaaaatgtgcctatctattaatattttttcttcaattcacacttaaaagaaaaatattacagtgtcttggtatctgtgcaatgctcatgtaggaatttattatgccaaagtgatctggcgtgcctaaactagcatgagcaatatgaaaatttaaagatagctgaatgcccattctttaattttactaaaataatgaaaaacatatattatctgagcttacaaaacatgtaaatatgaattcaaatggagcatatattttctacatatatattgcgtttttctactcagtattaaaaaccatttctctttttatgctttgctttcttttgtcctctaaaaagaaagagaagtatgaatcttgaaaatcatccaccaactctcatattaggaaactcttccttttaactttgaggaattgttataagttgtgatttaaataatagcttgtaaattttgacggcataagaagtccgtaaatagttgctcttcctttgaaaagggctgacactaaaagttagggcatttgaagtgttttgttggttttggggggactatttggatgtcaatattaaactattaaaacaggactttgagcaagaattgataacacggtataatgtcttttacctcccagctaccagtctgaccctgactcaggcctccggaagaaaccactcgctaatcacagtctgtcttgcacccagacacggcatctcagacactgcacaaattaagaagtcaccctcaaaacctctatacagtgcaggaatacagctaagacaccacacccgagtactaacatctgcaaattctgaaaagctcttcataataaaaagaaaaagaaagaaaaggaaacatttgccaccttctgtgtcttttcttgccacgtgtatctgctctcatgtgcagacactttaatattagatgagaaaatgggagaggaagctacgatagaagaagagaaatggagagagagctgaaatacatccatttgttttctttcaaattcattttatgggctttttgtaggaaggtgtttttttcttgattttttgctttatttctggcatcaactatctttgagtttgcttttgagtaagaaatattgaagagcagatgaaaagccagatgcagtggtaggctgcggtggaattaggtaatagttgcaaaaacctacttaatcttttgttttctttttggtttgagcaacacttagaaataaaatgggtctctaaatcacagatgatggctctggggaacgtaaaagacatcttttgaatatgaagaatactacaccgacaggcaggaggccttggaaagtaccaactttgccaatcgctcactgagtattttttgaacaagtcttattacctctagaccttgattttttttatctctgagattattctaacattgtatgtgaatattttgagttcttaccaaagcatgtttggcccaaggaagacatataatgacattgtttcgatcattgtgtttcacatattcagaacagaattgctcaccagacacagatctgggcacaaacccccttagctgatcacacaaacacattctgagtttccccctgtctgtaggcttgtcggagctcccgggctacaggaaaatgactcccaggattgaattcaaaggatgcaagtaaacacttactaattaaaagaagggttcattttatgctgatttacaaaacacattaattcctacaagctaagtctgtttttgttcagggttagtgtgggccaatagatggaaaattgttttaaaactgaaataataaacttttgggagaagacacaaaacccttactgtgtccaacttgtactgaagggaaattcctcttcactggacaaaaacgaaggcacatggtataccaggagatcgtttggtgcttgatgtcaatgaatcaggagcatcagaactatttttcttgtattaagcttttaggctgtgttttgccaacttgcacaggttgaagacagcattaatgttaatgaaggatggaagtctgagaggcagtgactctcacttccccacccccaccttacttcctttcatgctaaatccattagtatagatggatcgacattaatacacaagaaggacagaatcgctctccattcggggacacttttacttgacccttggcacacattgcccatacgtggccacaggacgtttgacctattcaatggcatttattcattcatttatttattctatgtgcttcaaaccaatttctccctaggtacgttacacttcttacacttagaatgtattaaaaagttaaaatctctgacaaggagtacatcagaaagaacttgaggacagagtctgtcattcatctttgtaacccttaggagctttagatccagctttgcacagtgtcttctacacagtaggcgctacataaatgctcactgaatgaaactgaattgaatcgcattgtcaaattctaaactgttccatgtgatcttattataaccttcttatcacctcctagtaagaagacatgtatcttaagatttatacatatacacacacgtttctaaaaataattttactccagtgaatccaagcaaaacatacagtgaatgtttctataaaagctagatattgaatactttaaatcttatatttacaaatgattttcattatgagtacgaaaataagcatagggctttctggatcagtacagaaatttgggttaaaactataccatatagctggaagggagcatgtaggtcatctgatcttgtggtcttcaaagggtattccttgtcacccagaggttccttcaagtactcccagtgttatcaagaggcaggaaggcagataaagtggtacaggcagtgtcaaaggcattcagctttctccccaacctttcaacagagaaaatgcatttcagaatatgtggggcttctctgtacaaatgtatttcaatgacaagtgtccactgctttaaaataattaaagcacaatctttaatttttttaaaaaagagagagaaccacactttgggaggccgaggcgggcggatcacgaggtcaggagatcaagatcatcccggctaccatggtgaaaccccatctctactaaaaatacaaaaaattcactgggcgtggtggcaagcgcctgtagtcccagctactcaggaggctgaggcaggagaattgcttgaacccgggaggcagaggttgcaatgagctgaggtcgggccactgcactccagcctgggcgacagagcgagactccatctctaaagaaaaaaaaaaaaaagagagagacagccaaagcaaagaagcaaaggactgaatgtttatgtctctccaaaatgatttcatgtgttgaaatcttaacccacaaggtcatattagaatgtggggcctttggaaggtaatcaagtcatgagggcggagctcttaatgaatgggattagcacacttaaaattagtccctcaacccttctacagtgtggtatggctcagaagacagtggtctatgaactgggaagtgggccctcaccagaccctgaatcaatggacacctcaaccttgagctttccagcccccagaactgtaagaaagaaacttctgttgtgtataatccacccagactatagcattttgttacagcagcctgaacagatgaatacaaccattttacaaacaggtaatcttaggcacagagattttctgtcattttgttaaggttatatcacatagctatggagttgtgccaaaagtcgggtctcctgatttttggaccaggaggtacagtcacagcttacctaggcagcagagaaaaggtaagagaaagagactttcttagattgaaatgggtatgccccaacctaaatctttacagctgcaaccacaggaactcaaaagaaaactaaaaatcaaccaaaaaatcaattaaggcgctaacactgacttgcgctccctgctggccacaataattaacaagaggctaatacctagtgaggatttattgattttttaaaaaaaccattggactctctctcatgtaacagaagacaatatttttctgtttctaatccctttggcttctaagaaatatacataatcactgggttgcttcaggataccaggtcctgggtatagtgcattccactgtattcaaaataaacaatatttgcctaatttataattatatctttcaatttgatattaattgcatatgagattctattttcatcaatcactgtttttctatttattagtgtccattactaattattaggagattttaccaatgctaccaaatgtaaatatagagtattagctataagtatctttgaggaaaagacatagtttattgctttgtagtaaagtttaatactttatatatgctatcatattcacaaagccaatgttgactcagtccatctaattcctggactacaacaaaaaataaaataattattttcattattagccaactgaaatctctatggactttaaaaggtttagtatctgaaattatttatttgataatcaggctcatgcttttgaactcttcaaaattgctcaatggtaacagacttcaaattgtgtagataatatgcacaggttaattcaccttttctcaaggtgacgttattttaaagacagtgaagaagtacttttaaataaaacacagccccagtctctgggaacatgcaaggctgtgcttttacaattgatacgcagaagcaatcatgtttggcgacagaccaccccatagtgggaactgctttccagcctggtttttatcagaccagcagctgctccatcagtccattagtgaccaggaacaaaatgcattttttaaaatcaattagcagcccctccaactgaataaagatccctggctatgcttttcatcaacaaaacaagagccaggagtgaataaagctaaggagatcataaattcttggaagtggagtcctaaaacctgagaaagccatacagaggttaacaggtcggaccatgccctcggcaggactccagtaactcactccaggcagacaagaaccatatatatacgtgtacatatatatatgaaatgtgtgtgtatgttcagagaatgacatttcccattatttctcagtagcttatcttcctaacaaccttcactgaaaggaagccattgatattcagcctctatgccacatttagccctagaaatgcaatcatgtgccatcccaaggtggattgtagaattgctatttattgtctcccataaaatcatttgtaattctagtattaaacatactttctgtcttctctagagaaataataaccatttatttaatctttcttcttaggtttgatcttctaatccctctgtcctacttctaaaatggcactgttatcctaaatctaattttcttggcacaatagtttgtatacattagatgctttaacaatattgagttataaaattattatttccccttgtaataacacattgagtatttgaagacaaggatataaaagctcccactaaacacatatcagttgaccgagtttcagaatggagaaaagtagaaaacgtaattccctctcaataaaaagaaaggcaagagtccgcccttagagccaacaggctgatgtgtacttactgcaaagcacagcaggccaatttgagaagagcagccaaaagataactagagcttgcagaacaagttccaataaacaatccaatcaacaaaaagtatactagggatttgaattgaagaaatttactgccaggaatgagttgcaagggtgaaagggcaaaggggatgctgaggtgacgtaaatatcagcgatcactggaagcaaaagcaacccctagggctgaggtagccagatggtggtaactgcagaaagtaccttgcaacctgaggccaggcgaactaaaggaaagaggtgaggttttgagatctaggagctcaaaggaggagacctgcgtacctggtgctcaaacctttgagataaaccagcacaatggtggtttggccaggaaagagcaggatggctggtgttggtgcctctgagggcacatcctagctggtgctgagaatgtcaacgaagcttgatggggagccttagctctcttctaataatgggtggttgctaacaggatctagaaatagagggtctttttgccttctccctgccttctaattgtctaccatttgcagaaacttacaagaagccaatttcacgggagcgtgagaaatgtagtttgcagactcctacccctagcatcaccaaacaaaatagagaagggtgggcttgaagctgagaggcaattgataaataaccagcacacatgtgtgcctgaaataacgggcccagactcgattttgttctttaaaagaataaaatgggtcattccaggtttatagctgtgcaccagtcctgtgacctggcagttgggagagttagattactgcatttttgaggatgcacaagaacatcaagaataaactacaaggccacggtgggccacacctgtaatcccaacactttgggaggccaaggcgggtggatcactcgaggtcaggagttcaaaaccagcctggccaacatggtgaagccccatctctacaaaaaaatacaaaaattagccaggcatggtggcacacacctgtagtctcagcttctcaggaggctgtggtgggagaatcacttgaacctgggaggctgcagtgagttgagatggcgccactacactctagcctgggcaacaaatagcctgtataaataaataaataaataaacaaacaaacaaactacagggcaggcatggtggctcatgcctataatcccagagctttgggaggccaaggtggggggattgcttgagcctaggagttcaaggccagcctgagcaacataacaagaccccatctttgcaaaaaatttaaaagttagccaggcacattggcatgcacctattgttccagctactagggaggccaaggtggacctcgaggttgaacccagcagtttgatgctgcagtggccatgattgtgcctctgcactccagcctgggcaatagagcaagaccctgactcaaaaataaaaataaacataaatctataaataaataaaagaataagctggcatcttccattagagattttttttctgcctgattggtgttttaggcaatcacaatttcaatttccatgggtagaaatgaaatctttagtcagtacaaaatattaatgtagttcactaaaatttaaggttaaggtagaaatcctcttatctacataaaggcttttcaagtacataggacactgtgaggattggctgaggataggcaagattcaaagtaaagtgtgtctgatttctccatgcctatctaagaatccccactccttgtccactgtgtgcccagaagctggacccctaccagtgtcccaactccaaaattttctcatgtccacctcaccctgatctcttaatgtcacttgactatgggttaagtaaaccaaaatctccctgaaaataattccctccagtgtatgagtgattactcatacactgattactcccccttaaccattccaaagatatcggtgtctttaaagcctgctagtcacctccaaattaatcccttactgttagaattttagaaaggaggatatttgggagcaatgggatctcactctggacttgtgggacaattgaagaggttctcatgaattattgagacgggaagtttattcaaagctcttagaaagatggtggcaggagcagtacagtttttcagtctctctcaatccacacatcaaaggagagagaacaattaaatccccaaaccaaaattccctagacaacattagcgacaaagctagatgataacatgtccccacacacatcagagtacaagtaggtggggacaaaccaccagcagccgaaagaactacgtgataggaacacgtgtgcaggaggaggcagagtgcagagacaggtggcatctgaggagccagagaacatgagcccccgtagagccaacatgcaaacttccacttgcaggaaagcatgattcatttgagaagaactgctaaaatggggaaggttttgccaatccagtaccaggtgagtgcaagaggcccagaaaggctaagaaggggctgaaacagtgtagccactaggaatgctcaaaaaccacccaccagggcacgcttccacgacagggtccctccagggctgagtcatccatccggcactgtagacacaatgtcaggggcccacggtactttcaggaaaccatgaaagatttcaatttcttttaaaatcaaaaaggaaaaatgcacttttaggtcaaagaaaatgttttaatatataatagatttgcctttatattccatgcagttgtaaaatataatttttaacatttttaatagaggaaggaacctacagaggcctaggacccacaggaatcacagtgaagccctgggccccacagagcacagaaatagtgggcagtggagtcaacactgagcaggacagggacaaaagagatgaagtcaccgacagtaagagggcttgaagagagcccagaagtctcagagcaagctgccatactcatgaacactacagaggagcaacagaagagggagctctgggaagttagaacagctacctcgaagccagactcattctttactttttttttttttgagacggagttttgctctgttccctagactggagtgcagtggtgccatctcagctcactgcaacctccacctcccggcttcaagcaattctcccacctcagcctcccgagtagctgggattataagcacacgccaccatgcccagctaatttttgtacgtttttagtagagacggggtttcaccatgttggccaggctggtctcgaactcctgacgttgtgatccgcccgcctcggcatcccaaagtgctgggattacaggcgtgagccacggcacgcagccagccagccttattcttaaagttcaagaaaactaatttcacatagaaatgaacaacagaaaggtgttgaggtcaaatctcatacaatgttatgataagatgagaacaagtcatagaataataccccaacagacaatgaaagccactagaaagatgtgtcctcgaaaaagaacaaaacagaaacccactatttcaaaacaacctaagacattaaggtaatgacataatagttgaaagagcaacatgaatcagaaatggaaaagtgcagaaatgagatgacaggcttcaggaaagaatcggaaattaaagtaaaaatcatttcagaaatgaagactaaaccagaaggaacactagagcttataaacacaatagataatgtctcacaggaaatagaaggtaaaaaaaaaaaaaaaggaaatttttaaacatctaaaataaataaatacacaaaagggattcaagagaaagtgaccaaaagacaggcagatgctgtcaaggatgtggagaaagaagaaccctactatgctgttggtggggatgtgaatttgtacagccacgtggaaaacagtatggagattcctcacaaaactaaaaatagaaccaccatatgatccagcaatcgcactgctgggtatatatccaaaagaaaggaaatcagtgtatcaaagagataactgcactcccatgtttaatgcagtacaattcacaatggccaagatacagaatcaacctaagtacccatcaacagatgaaccgataaagacaatgtggtacacattggaatattacacacatacacaatggaatattatttagccataaaaaagaatgaaatcctgtcatttgcagcaacatggatggaactaaaggacattttgttaagtgaaataaaccaggcacagaaagataaatatcacatgttctcactcatacgtgaaagcttaaaaatttgacctcatagaggttgagagtagaatgagggttaccagaggctgggaagggtagtggggaggggaagaaaagagggactgatcaatggatacggaagtccagttagatagaaggaatgatacctggtgttcagttagaaggaataatacctggtgttcagtagcacagtaggatgactgtagttaacaatttattgtgtatttcaacataactagaaaagtggaattgaaaagttcctaaaacaaaaaaaatataaattcttgaggtgagactatcccagttaccctaatttgatcattacctggtgtatgcttgtataaaaatttcacatgtatcctataaatatgtataactattatatgtccataaaaacttaaaaattaaaaaagaaagagatcaatcaatattgaaggaaagaaaaggaaattttttaatggctaatatgagtttctgaataagaaaatcaaaacaaaaaaacagaataaatatccaggcacggtggcacacgcctgtaagtcccagctacttgggaggctgaggtgggaggattgcctgagctagggaggtcaagacgacagtgagccaaaatcatgccactgcactccaacctgggtgacagagtgagaccctgtctcaaaaaaaaaaaaaaagaagataagtaaggaacattttatattaggtaatatcaaagaagctatcaatcactgcaagggtcatgccataatgactcagagtgagtgaagaaggccccactgtctaaagacgggacaaattaacttcaatactgatcatcattataatgcatttaaagctacaaaatgtgtttaaatccatgggtttgcactgctatttttttatctatttcagaagataggaaccgatttatcttcaaaactcgtaaataaaggaaaataaccatttcaaataggagccaaatcatagaagaaagaacatgtctatttatctaagtatttcaactaataaatgaaaaagaaatgatagaattaaaatatctctatttttgcatccacaaatgaatgagtatatattatggacaattagcagcaatggatgcgaaaaccacaagaagtgagacaatcagatattgcgcatcctttaccatcctgccaaaaatcattactgaaatgatgacttgacgactaagccaggagaaacactagagcatataaagaccgcctttagtcttgccaaagggatcaaacctgggtctgatccagtctctggattcagctgccaatgtgcaggaaattcaaaagacagaggaacatgttgaactgcaccaagagtatcaatcagcaaagtgcagactatgggaaactctacaggttaaacagcccgagttcatcaacctaatggaataaaatgaaagggatggtggagaaatctatacattaaaaagagacttaaaagacatccacttttgtaatgggtaggagtaaactgtattttgaggaatgcacatcagggtgataaagctgtttttttaaaacctcaagaaagttattactgtcaaagtgagggttatagttaccgtacttatggtgggagagggggtttgcgattgggacagggctatgcagggtgctttcggtgtggctgacaaggttcaatttcttgatctgagtggtgtctgccttctaataatttattaagccatgcaagtgatttctatgttttatgtgtctctgtttttctttacaatgaaaatagcttaaaactaataaagcccttagggaagcttctccttttactctgttacttctcctcttcctgaagcaacttcctcacctccatgtcaacaacactagcccttctgcacctccctcggctctgccctctgaagtgtttcttcttccttgtttgttatattagatgatcaatgaatattagtcacaattatagcccaggacatgatgccttgagtgctcctccagcctaccgaccccttctgagagagtagaaacctgagattcttcatatataggtccctatgcagtgctttatgggtctctgctaccctagcctagttgatagaactggggatttgtagatttactcgacatatatgtattaagcagctaataccatgtgttataacaatgaacaaaatagaataaggcccttctctcctgggtcaccctggcataggctggccccgtgtggtccggaaaaggcccaaggagtatctaattatcatcatcatcacagtgaacacttactgagtgtttacttattatgtgccaagttctgagctaagcactttaacaccattgtctcttgtttggttccggcaccaactcattgaattaggaattcatgctatcttcattttaccaaaggaaaaaaaatgaagcccccaaaatgtgcataacttgctttagtttatgcagctaataagtgcagctggacctggaattcagaccccaagcaaatggcaaagcctagcactcaaacaacttagtaggaaaaaaaaatcccaaagaatccaatgttaagatgggcaaaagttctgaatagacatctctcaaaagaagacaaacaaatggccaacaggtatatgaaaaaaaagctcaacattactaatcatcagagaaatgcaaatcaaaaccacagtgagatattatcccattccagttaaaatggcttttatcaaaaagacgaataataacagatgctggggaggatgcaaagaaagggaaaccctcatacactattggtgggaatgtaaattaatacagccagtatgaagaacaggatggaggttcctcaaaaatctaaacatagaattaccctatgatccagcaatcccactgctagatatatacccaagagaaaggaaatcagtatatcatggagatatctgtattctcctgttaactgcagtactattcacaatagtcaagacgtggaatcaacccaaatgtctatcagaggatggataaagaaagaaaatagggtacatatacacaatggagtactattcagccataaaaagaatgaaatccggtcatttgcaacaccactggtggaagtgggggttatgtaaaataagccaggcacagaaagacaaatgtcacatgttctcactcatatgtggaatctaaagttgatctcattgaagtagagggtagaattgtggtagccagaggctgagaagggtagtgggaaaggggagataagaagggggtggttaatggatctgaaaattcagctaaatggaaggaatacaatctggtgttcagtagcacaacagggcaactatagttaacaatttattgtatatttcataataactagaagaatagaattggaatgttctcaacaccaaaaaatgataaataagtgaggtgattgatattccagctaccctgatttgatcattacacattgtatgcttgtttaaaaattttacatttacctcataaatatgtgcacaactctttttttctttttttttttttttttggacagagtctcactctgtcacccaggctggagtgcagtggggtgatctcggctcactgcaacctctgcttcccgggttcaagcaattcttctgcctcaacctcccgagtagctaggactacaggtgtatgccgccacgcccagctaactttttttgtattttagtagagacggggtttcaccgtgctgcccaggctggtctcaaactacagggctcaggcagtccacccaccttggcctcccaaagtgctaggattacaggcatgagccgccatgcccggccatatgtgcacaatttttatgtgtccataaaaattttaaattaaaaaattaattaaaaacacttcaaagcccaagaccttaaatgtgatcactggttaaaccagtgagtatcttctattgtaaaatataaatgtgaattagagaagaatctagaccaaggatagacaaactatagcctataggccatattcagccacaccatctgtccttacatggaccataagcaaggattagtttttacctttttaaatggttgaaaaaatataaaagaagaatattttgtaccatgttgagcctataggaaattcaaatctcattgtttgtaaataaagttgtattggaacacagccacaccaatccattttcaagctgcccaaggctgcttttgtactacaagggcatccttgagtcatgacagcagagatcacagggcctgcgaagactcgaatatttactattaatatctatcttgacttttagagaaaaagtttggtgacttctgatttagagaacagatgggtgaacttaaagagagagaagagaaaaaggcagtaatcagaagttctaaggcggtagaatccatgagcaaacagaagttatgaggtaaagagggaagcaggggcagggctgcccgggaacagaagaaaagacaagagtagctgaacaattgtacctttagagcagggctcagcacttctaaaactcctgtcccgcaagacttgatccacagtggctaagacggtcagtgttttgccttatcccttcatgtaaatcaactgcaggtaagttacgtacatttctgtttatggttccctggaaaagtctaacacacaatttgcctttaattctcctctctgaccccagattcccctgaatctgccaccaagaccaccaagaaaatgtctgatttgaccccatgtttgcagagcgtggtgacatgcttacaggttctctaaaatgtcaggatcataaaccaccttttcctttccatttcagtgctctcacttgagacatccatttcttcatgtctcatccttacctagaatcagaaatagttggccaagcatggtggctgacacctgtaatcccagcactttgtgaggccaaggcaaaaaggtcacttcaggccaggagttaacgaccagcctcggtaacatggcaaaactccgtctccgtaaaaaaaaaaatatatatatatatatatacacacacacacacacatatatatatatacacacacacacatatatatacacacatatatatacacacatatatatatacacacacatatatatacacacatatatatacacatatatatacacatatatacacatatatacacacatatatatacacacacatatatacacatatatatacacatatatacacatatatacacatatatatacacacatatatatacacacatatatatacacacatatatatacacacatatatacacatatatatacacacatatatatacacatatatatacacatatatatacacatatatatacacatatatatacacatatatatacacatatatatatatatatactcatatatatatatatactcatatatatatatatagagagagagagagagaaaattagccaggcatggtggtgcacacctgtagtcccagctactggggaggatgaggcaggagaatcccttgagccctgggaggtctaggctgcagtgagacgaaatggtaccactgtactctagcctaagtgatagagcgagaccctgtctcaaaaaaaggaaggaagggaggaaaagaaaggaagggagggagggagggagggagggagggaggaaggaaagaaggaaggaaagaaggaaggaaggaaagaagggagggaggaaggaaagaagggagggaggaaggaaagaagggagggaggaaggaaagaagggagggaggaaggaaagaagggagggaggaaggaaagaagggagggaggaaggaaagaaggaaggaaggaaagaagggagggaggaaggaaggagggagggaaagaaggaaagaatggagggaggaaggaaaaaaggaaggaagaaagggagggagggagggaaggaaggaaggaatcttcaatagttacacttactgtttatagggtgaaactcaaactccaagcccttttccatggcatctcgccctctcaccatctgatcttagcccaaccctctagaccttccttacgggatctgaatatcaaaacagtcaggactgcatgacttcactttacttatacgtggaatcttaaaaagttgaactcatagaagtagtgaggagaatgttggttaccagaggcaggggggatgatgggcagggcggttggaatagttgaccaaagagtacaaagttcccgtgagacaggaggaatccgttttcagatctactggacagcaaggtgaccataactaataataatgtagtggatatttcaacatcgctaaaaagaatagatgttaaatgttctcaccacaaaaatatggcaagtatgtgaggtgatggatatattactcaggtcgatactgtataatcattccacaatgtattcatatatataaacatcacattgtgccccatatatatacaattattatttgtcgattaaaaatgattgattttcaggtagaagagtcttgactgtgtccagtgcttaactctgcagcctaagcatcccagagggagtgctcgctctcagagagccggggctgaggctgcaagtctcctagggtccagccacctggcatagcccaggcactcaggaacaatagctgacactgaacatgtgaatatgaactcagatggctacaacccggtgggacactgctgaggcctgtgtaggagcccagatgtgtaagggaatcgctagggggtgggttgtgaaggagacactgagctgccagctagtgacagcataagaggttccagcagtttatttaaaaaatcaaagagccatagaccattggagccctggagtaaggaagctggtcttgatggtggtaatcagactacttggtgttgggagatagcctctcatgtgtccacatgagattagaaacccttgaggatgacttcgttgatttgctagacttgttcaattgatccattaagtgatcaattactggcaatgattagcagacaaagcttggtatttaagtatttgggatgtcccgtctaatgtcatggccaagaatcaaaatgcgctttttaggaatttaatctcatcttatcaaatgacaaaaaaaagagatctttcctgggaactcctggaattgtgctaaaattgtttctgaatcacgtgtctgtggataaataattctgaggtcttcccttgctttgtattgcatggagtgtgagacaaaatacaaagggagttaagagcacagcctggggtatcagaccatctaggtctgagcctgcctccgcctctcagaatctgaccttggcccgtttcctagcctctgaaagcttcagtctccttacctataaactgggatcaggattatgcttatctcccagggttagtgggaggattaaatgagataagacacatcaagtactgtacttaggagtgcatctggcattcagtaagtgctcaataaatgttccctgtcctctcaactgcattaccttttacaccagaaaaccataataataacagtggcaatttaaggagacagtattaaagagaattagcttatgaaaagttaagactctgtttattctttccattcaaaataaaaaatttacaaaataatgttttttacaagtctaaaagttgacccacttaaaaaaatgtttcatgggaattacactaaactggcatttacacatttcctataaatacttatattaatctgtacagttctaagaagtaggctcaccagctaaaaagtctctggacatacaagtatgcctagtgagttcattctagagaattcaaatgtaaacccaattaagatacacttttaatattgccgaaggcactagataaatattttaaatactaaaatctggccagagcaaaggtagaaatcaattgttctttcatttcacctgtaagatcttaataattaagttcagaaaaacagaattttacattaatctgacagcattagctgtaagtgaactcaatcaatggcctcttcataatgaaatttcttagctcaaaattttaaattacagtgaaagataaagtagaatgaaataccagggaacatacaattcatggctcacctacatcttcactattaggtaaagccctacacacaaagcctgcaatccagcactgcccctcactcactgccctgcccacagcagtcccttttttctgctgacagcaaagccaaaggagaggaatacccttcatccaacttcagaaaaactccttcttctgacatcaaagctttactgctaaggctgtgtttaaaccattatggttgtgccattataataatggttataagactactgagtgacaaataatacttgatatctaaatggcccctttcaacctttctgtaatgtcactcataaaattaaaatgaatactgtctttcccagattgacacagatatgcaaattgtcctttattttatcgggtgttctttgtatttgcagatattgcactctgcatccttccagagtccaggtgtcttaatgtaaatcacagcttttattcaatcaggtaaaaggatgagaaagtgtcattgcctccctttggcactatcctgggcttgcaccagcgaagtgctggtaaatatttaacacccagtgtggtggtgtaatatacggtggtgtaaacactcacaccatgaccaatttcaacctgccaaggtgatgtcactgaccatggaatcaggaagggatgcacaccatcagctcccaaacatgttgtaagccagagccagggcacctctggcctgaatcaaaattctctgatccagtgtgtccccgtggaaaccagaaatccaagcgagaccaggtgcttattattcaacatgatccccttgaatagggtctagccacctccactcttctttggtaaatcccatctccatatcttgtaggtcactcctttccagggacctgcaaagtgactgtcaccttttctataaaaagtcagagaactgagaaaggaatagctgttcactagacccttcctaacagatcatccagggttatcactgttgactcttttttttttttttttttttttttttgagacagagtcttgctctgttgcccaggctggagtgcagtggcacaaacttgggtcactataacttctgcctcccgggttcaagggattctcctgcctcagcctcccaaggagctgggattactggcacctgtcaccacgcctagctaatttttttgtatttttagtagagacggggtttcactatgttggcgaggctggtcttgaactcctgacctcaggtgatctgcccaccttggcctcccaaagtgctgggattacagggtgagccaccgtgccaggactctctgggtaattttttgttgttgtaggtcaggttattttctcctaagattcagttttcattctcattgaaaacagtgggattcagcttcacggtgtgtaagaatcacctgggaaacttgttagtaatgcagcttctgcctgtaatcccagcacttcggaaggtggagacaggagaatcacttgagcccagtagtttgagaccagcttggccaaggtggggaaagctcatttctacagaatgttttaaaaattagctgggtatagtggtgcacgccaatagtcccagctactccggaggctgaagcgggaggattggttgagtccaggaagtccaggctacagtgacctgtggttgtgccactgcactccaggctcagcaacagagcaagacactgtctcaaataaaaataataatgacaatgcagcttcccagccctccccgacctttctgattcagtaggtttgagtggcaataggagactgcattttaaataatcctcccaggaagttctgaggccggagtttgaatctgggcttaatgcaaagagtttgagccaactactcactttaaaaggaatagtcaacacaagacaaccctcaactctgacacaaatgacaagtttgagggattcccgaaaccatcatcagtttcaataatttgctacagggactcacagagctcactgaaactgtgatcctcactgttatggtttattgcggggaaaggatacagatcaaatgcagccaaaggaagatgtacgtagggccgaggctgcggaagtaccagacacagctctcattgtctccctcccatggagttagagcacatcagtctcccagtttcctcatgtgacagtctacatagagcgttgccaaccagctaagctcacccaagcctcagtattcagaatttatatttggcacccttatgtagcggattgattgattgtccacatgattgatctctgtatccaggtggcctgactcaaagctcccatccttgacttggaagtttgacttggaagagtgagggaatgggatgatgaggaattacttaataggtacagtgtatgtcactcaggtgaaggatgtcctaactgccctggcttcaccactgtgccatgtatgcatgtaacgaaactgcacttgtaccccatacatttatacgaaacaaacctcctactctaaatcgtactgttgggcttcgggatggctagccttcaccttcaggtgtggtaggcccccaccctaagtcaaacagtcacaatctggctagcccaagcctcccctcccctgacccccagcaaatcaatattaccaccagggcaaaggccagaccgacctcttctagggcaaggttaaatcctgcggggcacggtggctcatacctggaatctcagcactttgggaggctgaggtgggtggattgcttgagcccacagtttgagaccagcctgggcaacatggcaaaaccccatctctacaaaatagacaaaaattagccaggtgtggtagcgcacgcctgtagtcctagctattcaggaggctgaggtgggaggatcacttgagcccggaagtcaaagctgcagtgagctgtggttgtgctgcactccagcctgggcgatggagcgaggcccctgcctccaaaaataaaaaccaaaaaataaaacaaagaaagaaacactcccaaaaggtcagtcagacttctgtctttggaaaaaccaccttggccatcaaactaaatgtcctataggtgagccttttgcttgaggctggcaagaggttgccttgggttttatttcttcagtagggtgttaatccatgagtgaaggcctaaagtcggttttttagagtctttggggtagcttaagaacagtattaaataccacatccaaatatgagcacctttgaagctgggagcataataagtgctatgtaagagattactattaaatagtgttagtattcatattggtattagcatcagtatcagctgtgggaaactggcctaccatgtgcagaaataaaaccagaaccatatttcagctcatgggacaccaagggtgagataatatctcaagacaaaaacttggaatattgaagaaaaggtgaaagtggagaactctgctacaatacagtcccaaggattaagctgagagttgtcctcggatttccctgcttacctcccgtcaaatgcctggcccactccatctagtttgtacttgtctagaatatattctactgtatggaactttccttatttaacaaaagagagtgttatgaggcaggttcactgtgcgctggttagtacttgcctgagtctggtgaaacagaacatacacacacacacacacacacacacacacacacacactacacagagtggatttattacttacagataaacagcaagggacaaaaacccagcattcatgatgagctgatccctcaaggctctggaaagctgcccaggaggatacagtctcatctgctcatgccttaattgcaccgcagctgaaggaccccagaaagcagcccaccctgggttttacgccccgggtgtcacatgactgctgggctgaaacatcgaaggacatcctgtttctgggggtttctagcctgggctgtttggtcagttctccccttttctcaggatgttgcattcctggcacattcgacagttattcttgagaactggaagcgaaaagtggggggacattgggttggcccaaggccacctggagaactgtcctgctagtggcattgccctcttggagtcacagagctcattaatccagtgaaggatgaatctgtccacgaagcgaggaaagtcacaggcttttaaagaaggacaggtacttaaaaatattccccttttatttttttcctgttaatcacatttctgagtgagttgaagaaaatctactaggaagtttcttgatttactgagtaggcttaaactttttccttatgatgcttaacttcaagaggggttcagtcagagccactgtataactaaaggactgatttccaaatagtttcacagcccttggaatatttaaatggttactttacccattttttagataggtaagtgcaatacaataaaatgcttagcattttcaaggagcgtaaatcaaggttcttcaagtcactttgaatttgttttgacatttttctgtactttatcacaatcagagaagcacctcagatactgtactagtaaaacaagtgacataacttttcacgggctccgttcacccctgcaattgcttcagtctccacttagacttgccagcttgtcactccgtttacagcatcagagcatgtgcccagcctgcaccgtaccctgctactattcccagctctcagccacctacatctcgctcttacccacagcctcatagccatccctgattatactggaagttatagaaaacgtttatctgctgctaaaatacctacagctgtggcaattcacatttagggctttaacgtgtctaggtgatgaagttttgacaggaaggctccaataaaaggatttcagatacatgggatgtttttccttcgtttcctggaagcaaagacaactgaatgaggaatactgtttcctctttataaaggcagacttgggaaatataacattcttataatgaatccaaacaagttgaatcacaaaataatgcaattcagtcatttacaaaaatgcgttaagcatctacactaatctaagcattttgctcagtcctaggaatatggaatgaatgagacctattccctcccttccaagatcttgtaggctcatatggagaggggtgggtggaatcgtggaagcaaatgattccaaataagtccgaagaggataattccaaatacaattgctatgtgaaaagagcaaaaagccaagagaacatgcaatgtataactactcacaaaactcaaaatgtggtctctcagctcttcccccttagggttccttgaataagcaacctcaagtctttcactgtaaatcattttgttaactaaggagtatttttagtctatttttatattagcatgatgaaatagaaaagtcatcatcaagaaaagtgtatgaataatagtacttaattcaatttcttagactgaaagtattttattatctactaatatttctaaatcaataccatgccaattataccagctttagtatctgcagttaacttatatagccagcatattaggcctcaattctaccaaaaaacatatttagaaagtataatttggcaatggttacactaatattaggctaaaaaagaatttcatattaggttgatccagatgttgtgattatactataatttatgtataattatatatttatattttatatacatttaagcctataatttatatatttatatatattatcatttataaattatgctttactctatataacatattcatattataattatgtcacatatagtataatatatatgccataatttataatcactacagatagtgattataccatataatttataatcacaacatatagtgattatattatataatttatatagctactatatatagaatctggagatgtggaaaatgtagacaaatcgttttgaatacgaacttattctcactatgacagaaagaaaaatattacacctaacctcatatactatgaaagaaaattaattaaaatgttggcaattagaaccaataaagacatcaatgcattttggcataaaaataaggtgaagtgtacgatattgcttcccagatatgtctatagtaaagtagcccagagtaggggcacatctgccactcacagctgccttggttacatgaccgagttaaggatgccatactgaggtccgaatttcactttctcccattgtcctccggaccttgtaacagtaagtactctatgaaatgtgttgatgtttagaaaggaaagtgaattaaaattaatgaccctctcctctaaaattgcatgtgtggatgaggcttagaaatcatgtaattgcatcttcaagaacaggagtaggcaaactatggcccatgtgccaaatccagcctaccacctctttttgtacaccccacaagatgagaatggagtttacaatggagtttatcaatagttaggggaaaaatgaataaaatgtgacataaaaattacttgaaattttacgtgggaggctgaggcagtagaattgcttgaacttgggaggtggaggttgcagtgagccgagatcatgccactgcactccagcctgggagacagagcgagactctgtctcaaaaaaaaaaaaaaaaatacatgaaattcacagttcagtgtccatgaataaaaggtcgtgggacacagccatgcatgctcattatctatgccttgtctacggttgccttcctcctaccatggcacagctgaggagttggcctgcaaagcaaaaatatttactatttgcactgatccctattcaagaatacagttactttagtagctcttttatgatttatttatttattgagacagggtctcgctctgtcacccaggctggagtgcagtggtgtgatctcagctcactgcaacctccacttcccaggctcaagtgatcctccctcctcagcctcccgagtaggtgggaccactggcatgcaccagctcacccagctaattttttttttcttttgtaaagactgggtttcacctaattgcccagactgttctcaaattcctgggctcatgcaatccacctgccttggcctcccaaagtgctgggattacaggtatgtgccactgcgctggaccagtagctctttcagaacctcgaaagcctaatccagaattaaggaatggggttgtcaatatggaaaagaggttgatggtaaacataacaaaggtcttcccatatatgatgtcagtatgttgcctgatgagctttcaaactaaagtaatggaattctctacagatgtaaaaagattgaatagacattcacgatttggcataattaagacttaggctagcctgaacctgaggaacaaatagatgatcgaaactatagaaactataaggccattataattttcttagaataagtaacttttagactatgatgttgtgaaaatctacaatttcaggacagtttaaccaactaggaagtggaaagtgctgttgttagcatattgaatgcttccatgtaagtttttgtaggtattctcaattttttaaaatccgaagtaaagcatgtcaactaacaatggaaaacaaatagttatgtagaactctctcatggtttcatatgaaaattatgtagatttttattaaaactttggaataaaaagactgtatccggatatacaagtcttcttctcttttttttttttttttttttttttaattagccttctttcagagccaattcagtctgacaggtaaatcagcatttagggacttttattgttcaggcattaatgccagcttctcttcatacactctgtagtactcagcttccagaagcaataaaccataatggtctcactcactgaggccttttaattcatggatcatagacatgataaatcataagaactcctctggtgcctttttgtctagaatggccagattcttgaaagccaaatacagaacacctttttaaagggcatgtactcaattgaagaaggatgttcatattcaagaaagcggcgaaagtgtttatggatgcacgtgcaatggaaagataatacactgagacaaatgtggacccacagatggacatgcttctatgggcagacagcaaaggagtcttttccttaggtcctttattttctaacataccattgggattctgccacctaaggccagtttccccatttcaaggaaggcagttgtaagagatttatttccttatcttgaaggaagctgtcttggcatacctcaagacaggctggaggatccaagctctgtttgctgtaacagatttactcaggaaggtggagccatagaggaaggattggtgaccaatttgttgtaaatagagttaacatttaattcagcttctctctcaagaccccagcccaggccacaagtaacacattttctcagttcttaaagtcttgaccgtaaagctagaaaaattccatccatggtatacactcttctttcttctatttttacattttaaaaaattactggctggaaagggtggctcacacttgtaatcccacggctttaggaaaccaaggccggaggatcacttgaccccgggagttccaggccgcagtgagctatgattgtgccactgtactccagcctgggtgacagagggaaatcctctctctaaaaaataaaaaatgaatgactacatttttctcctttcttccaaatattggactttttattgacctgaccacaaatagagtatagcgcgccctccccaacaaaaccccaaccccacagatgagctgccgtgttttctcttagggcagtttctcagccacattcacggactgaccgttttccctcccctcatcaccttgtggggaaaacagacttttgtgcacaacactcatttgatgaggttcttcagatgaaggagaaaaaacattatcactaatagtgttttaaaacattctgaccctttgtagcctcaaagttaacactagtttataagatttcattgggtcttcacagagaaagtaatcaatgactattgacatccctcagcacaataggtgttaaatcgtagtgtaattttctatgtgtctaaaaggattttattttactctacttaatgcagcttttctagggaaaacaaagagcagtcttcaagttctgtttcccattctcctccttgttcaataaatgccaaatataaaaaccgtatacaaagttgagcacatttgtttacatgatcttttcatttttgcgtttatgctaattgccatcccggaatctccactgagtgatgtttttaggattagctgtcaagaacttggagtttcagctcgatattgattctcctcccttggataaatgctgctcacacttactaaaaaggtcaatattattgctagttaaggaacagctaggaggcctgctctactgctaacagtctggatgacatgcttgtaagactttgtctaacatcagtatttaataatgttattaaacagagtcttattggccctcctcatctgcagattataaaatgtatcaagacattcacactgaaaatctaactggtattctgaaggttaagacacatttatacttataaaaagctggctttttaaatgattaaatggtttgcaaaatagtcggtgcagtttaacaaaggacaaacaactgttttatctggaagtgacttgtgcttccggagacaacactggaaaaatcatttccgtttgttttcttttaatagacttaaagatttcatttgctatcttaattttaaagcggatttgagatcatccatgtgcttgcttctctttttctcttgggttgtttttcttaaggtcattccacaattgaaatgcgtctacaaagaaggggaaaggaggtatcactgtcttgtaaagaactcacagagaggagaatgaaaattgtgtttggggagtaggaatagatttcacctgttccttctatccttcctctctattacctgagataattgagagttgactggacttaaatgaataatgaatatataccaatgcatatatgaaatgaaaatgttagattattttcaagtaccaaaatctcattacatccgtattttcttaaaatatacgcccaccatgctagtaaagttagtctgaaacaagtcaaacaccaaataagtattacaaatacgagcaaatgtgtgtgtggtgggagaagtgtgggggagaggaagggagggtgttgaggacaagagaaggggaagagagagacagagaggaagagagaattaattaaagatttttactttgaacattaagaaacattcagaaaacatcaagaagtgattcactcttgctacttttaaacaattggatgggactctatttaagtgaattgttcccaaatttcttcaccagaatatgctaagatatactcatcatttaatttctttcccaatgaggcaggaccatcattataaatattgcacaatgttggtcttggaaaataccaaagaatgtccagatatttgccctttatagtaactgaagtcagactaccctgctttttgagtaattctatctggttttaatatttttgggatcagctttcctcttttcaatgcctcatttcaataggaagactctctgactgtctatatctaaaccactatgcatttcaaagccatataatcagtttgttagaatcatgtgcagttgttagaattaaaagcagttgttgagaaagaattttagaagttcctgtgaatcaaatgcataaaatttagtccaagaattttttgacaactatgaagttcctatgaatgaaatgcatagaatttagtctgagaatttttgacaactattatatttaaaccactcaaaatattaataatcccctcgctttttctcctcttcctcctcctccttcttcattttatttatgtatttatttttagaattttattccaatcgtttttagggaacttctttttttcttttcttcttcgccacaatccatattgccataccattacatttcagatatgaatgtagaaattctaatgaactgacactaaagattgattatataatatatatgtttatagatgtagagacagacatagatacctctattaaaatgcataagtaataaacatcttctgttaaggaaaattacatgagcctgtgttttctttagttgagttagagccaggtgggtactattgggcaaaatccccattttagagataacactaggtttgtgtttagttgtttatatgaaatacatgcaacatatacaaatgaaattatgcttagtgtgtatacatatactattttatttatttatttttggccaggactctaaggtcaactattttattttttaaaatagggaatacatgaacaaaatccacaaatccagccaggcaaagtggctcatgcctataattccagcactttgcaagactgaggcaggcagatcacttgaggtcaggagttcgagatcagcctggccaacatggtgaaacctcatctctggaataatacaaaaattagccaggcatggtgtcgggtgcctgtaatcccagctactcaggaggctgaggcagaagaattgcctgaacccaggaggcagaggttacagtgagccaagatcatgcccctgcactccagcctaggtgacagagtaagactctgtctcaaaaataaaaataaaatatctacaaaccctccagtccttccaattgttgccagtttcctctatatctatatttggaaaattcaagaaacaatcattggatgcttgttatttcacatactacccttggtgctggaagcagaaaaattataagacttggagtccccacccttgaaaaactcacaaattatgacagaaagttaaatatataaaacagttacagttcagttattcattcaataatcattctttgggtgccttaaatgtatcaggctcaatataaccagtacaatagttgaaacattagctaagtgctgtagagttgccttgatcttgtactcaatgagaagtaggcttttcccaaggcagggaatgggagacagaggaaattctaggctaagaaaacacctgatagactttgataacataatttcagaggatatctagttcagtgttttccatgtaaaaattttcaggctagcaaggcagctttctcttttctcattcaccctttcccccagccactgcttggcagcaatggttttagcttggttatgttttcttcctattacttctctggtccgtactatccatattatcatgtgactcaatggacattgatatagtccagcactctcatgttatcaatgagaagactgaggcccagaaaaataaaagatatggccaaagtcaccagttacgttttttaaaaattaatttgttttattttttagagatgttttaggttcacagcaaaatcaagcagaaaatacagagttcccatatatcctgtcccccctacaatcaacatcccacaacacagtggtacatttgtacaatcaatgaacctacattgatgacacatcattattacccaaagtccatagtttacattaggattcactcttagtatgtacattctatcagtttggacaaatatatgacatgtatccatcattgtagaacacacagaagagtttaactgccctaaaattcctctgtgctcagcctattcatgccttcctcccccaaaactgtggcaaccattaatcttttgattgtctccatagttttgccttttccagaatgtcatatagttggaatcatatagtatgtagccttttcagactggcttttttcactcagtaatatgcattgaagtggcttctgatatggtttggctgtgtccccacccaaatctcatcttgaatgtagttcccataatccccacgtgtcataggagggacccagtaggaagtgatttgatcatgggggtggttcccccatgctgttctcatgatagtgagtgagttgtgatgttgagatgacatggttttataagtgtctggcatttccctgctggcactcattctctgtcctgctgccctgtgaagaggtgtcttccatcatgattgtaagtttcctgaggcctccccacccatgcggaactgtgagtcaattaagcctctttcctttgtaaattacccagtctcaagtatttcttcacagcagcgtgagaacagactaatacaacttccatgccttttcttggccagataggtcatttgtttttagcattgaataatattccatgatctggatataccacatttaattatccaatcaactactaaaggatatattggttgtttgcaagttttggagagtgtgcttggttttgtaagaaatgaacaaactgtttttcaaagtgcaccactctgcattaccagcagcaataaatgaaagttcctgttgctctacattctcaccagcatttggtaccatcatgttttggattttggccattctaatagttgtgtagtggtatctcattgttttaacttgcatttcccaaattatatataatgttgaatatcttttcatatgcctacttgtcattgtgtatcttccttggtgtagtgtctgacatctttggcccaatgcttaatcaagttgttaattttcttattgttgagttttaggtattctttgtatactttggataacagttcttcatcagctgtgtcttctgcaaatatcttctagtctgtggctcgtcttttcattctcttgacactgtcttttgcagagcaaaagattttaagtttaataaatcccagcttatcaattctttcttgatcatatttattgacaaaggcacggatgatgtgtttagtgttgtatctaataagtcattgccaaagccaaggtcactgagattttctcttgtgttatcttccagttttatagttttacactttatatatgggtctctgacccattttgagttaatttttgtgaacattgtgaggtgtgtgtctagacttatttttttgtatgtggatgtccagttgttccagcattattgaaaagaatatctttgctccactgtattgcttttgctcctttgttgaagatcagcaagctatagttatattgatttgtttctagactttctattctgttccatagatatatttgtctattctttcaccaacaccacactttcttgattattgtggctttctagtaagtcttgaagttgaatagcatcagtcctctgactttgctcttctcctttaatattctggatatttttttccatataaactttggaatcagtttgtcaactctaagttatgcacaaaaaaacttactaagatttaattgcagttgaattgaatctgtagatcaagttgggaagaactgacatcttgaaaatattgattcttctcatccatgagtaatctctccatttacatatttcttgtttcatatcttaaatcagagttttgtagctttaaacctaagtacttcattttttacgtgctaatgcatatgatggtgcatttttattttcaaattaatgtgatgttaattgctgctatacagaaaagtgatcaatttttgcatattaaacttgtttcttgtaaacttgctataattataataattataattatgatgattatcattaattacttattaattccaggaggtttttttgtcagttctttcagatcctatgcagacaatcatgtcatgcacgaacagagacagtattatttcttcattcccaatccatatacattttatttgcctttcttgtcttattgaattagctagtacttcaagtacaatgatgaaaagcagtggtaagacaggacagcctggctttgttcctgatcttagtgggaaagcttcaagtttctcactatgaagtataatgttagctgtaggggtttttttgtagatttttaaattttattttttatttatttttttagagatgggggtctagctatgttggccaagttgatcttgaactcctggccccaagcatcccacccttcttggcctcctaaagtgctaggattacaggcatgagcctgtaactgtgccagctcccccctccacctttttttgtagattttttaagaattgagaacatatctcactgttcctagtttactgagaggttttcattatgaataggtgttagattttatcagatgtcttttctgcatctatgaaaatggtcatgtaaattttcttctttagcttgtcaatgtgatggattacattaattgattgtcgaaccagccttacatacctgggataaaccccacttggccgtggtatataatactttttatacattgttggatttgatttgctaatactttgttgaagatttttgtctctgtgctcatgagagatttgatctgtaggttgttgaaaggcagacataatgttctgggtacaaaagaactgcaaaaaaataggccattagcgatgtggtggtcaggtgtcaagggagaggaagcattccgtagtcccatgacagggtctcagtctttcagtaagtctgtgcctttggactggaactgttgtcaccattgcttctcagccctccctcccttgggtgggagagaatggctggaaggggctagagatgagtatttccctccccccaggtagattaggctctgacaaaattccagcaagttaggatctggtaaaagtttctcctgagggcggaacttgttaagaaaaacaaaatgctccgatgtatttcgaaatggctccttttcctctctccctgccgaagcacgaagaaatatttctcctatatacaccaggaagaactggtagagctcttaaaactcacaaaagtgtgaaggcccctcgactgagtctccgtggagtttttatctctcagacttggccacacggagccttcagcaattcatcaattacggttccggtttacctccctggcactggttccagcagaggtttctgcaggtgggtttctgctccacggatacagagaattgtgattctatgtacctgcccatttatctctccaaatttgggggcagcagctttccctgtgacctcccttctttgagggacctaaagaagttgttgatttccagttcattcagtgtttttttcttgttcttaggacagagtggagacttctaagctccttaaatggcagatcagaaactatggaaaaaaacacacagtttatttcattttagatagggtcttgctctgtcatccaggctggagtgcagtgacatgaccaaggctccctgcaacctcaaactcctgggctcaagctcccacctcagatccccaggtaactgggactacaagtacataccaccgtgcctggctaattttataattttttgtagaaacatggtctccatgtgttgcctaagctggtctcaaactcctagactcaagtgatcctcctgcctcagcctctcaaagtgctgggattagaggtgtgagccactgcacctgtcctccccatagtttttagataaacataatctacaaattgtgagtccactgacagttttttcattaccacacaaatacacacatgcgtgcgtgcgcgcacacacacacacacacacacacacactcctttctcttcttcacttttggttagtcccttgaagagaggttcaggcactgaacctttctatgttttgatgttcttagacacacaattccttaccattgtgttacaactgcctacagtacttagtacagtcacatgctgtacaggtttgtagcctaggagccataggccctaccatatagccctgatgtatagtaggctgtactatctaggtttgtgtaattgctctctgtgatgtttacacaatgatgaaattacctaaggaggcatttctcagaatgtatctctgccaagcgatgcacaactacacatatgtacctacatatatatgtgtgttgtgtatatacacacgtgtgtgtatatacacatgtatttgcttgtatgtatacatatatgtaacaaataggtaaattatctagaatgttataaagtaataagagctatgaaaatatatttgtgacaaagcagggtatgtgggatcagtactggtggttggaagaagggtcatttgcaactttaaaaaaggtagtcaaatgaaacttccttgagaaaaggaaatttgaataaagacttcaaggaagtgctaaaaagaaatgagggagtgcatcaaaactgttctgagcaagtgaatagccagtgtccggtaccaagtatgcctgatgtgttcaagggacagcaagcagaccaggattcctgaggtgttataaaaatggaggaaggttctagaagttgaggtcaaaggggtaacagaggatcagatcatgcaagacctagtaagatattataggaccatggctttctctctgactgacttgtatacgcattgtaggattttgagcaaaggcatgccatgttctgacttccattttgtttttatttattatttatttttttgagatgcagtctcactctgttgcccagtctggagtgcagtggcatgatcttggctcactgcaacctccgccctccgggttcaagtgattaccctggctcagcctcccgagtagctgggattacaggcgcccacacgacacccggctaacttctgtatttttagtggagacgggttttcaccatgttggccaggctggtctcgaactactgacctcaagtgatccgcccaactcggcctcccaaagtgctgggattacagatgtgagccaccccgcctggcctctgactcgcattttaaaaggtgcactctggcttctggattgagaatatagacaataaggagtcaggtgtagatataatgagagtagttgggctattgcaataacataggcaaaataacgttggtggctaaggataatacctatggaagtggtaagactaggttagactctggatatgcttttaatgtagagctaaagaccacttcaataaagaccactgccataaagctaatatcacaataacgtgagtcacatggtttcttttggtctcccagtgcatataaaagttatgtttacactatactattaaacatttaatagcattatgtctaaaaaacaatgtacataccttaagttttaaattttatcattaaaaaattctaaagatcattggagccttcagcaagccataatatttttgctgatggagtatcttgcgtcagtgttcatggctactgattaaccagggtggtaggtgcagaaggttggggtgattgtggcaatttattaaaataagacaacagtgaagttgccccattgattacgtcttcctttcacaagagatttctccatagtgtgtgatgctatttgatagcattttacctacagtagagcttctttcaaaattggagtcaatcctctcaaacctttccactgctttatcaactaagtgtatggaatattgtaaatcctttattgtcattttgacaatgttcacaacatcttcaccaggagtagtttccctctcaagaaaccactttctttgctcttccataagaagcaactccttatctgttcaagtttgatcatgagattgcagaaatgcagactcatcttcagcctccacttctatttctctttaatttctactatgtctgcagcaacttactccactgaagtcttgaaatgctcaaagtcatccatgagggttggaatcaacttctttcaaactcctgttaatgttgacctcctcccatgaatctcaaatgttcttaattggatctagaatggcaaaccttttccagaaggttttcaactgactttgtccagatccatcagagaataaaaatctatggcagtgacagtcttgcaaaatgtatttcttaaataataagacttgaaagttgaaattactccttgactgatggactgcagaatggatgtggtattagcaggtgtgaatatctgcgcatctccatcagagctcttgggtgaccaggtatgttatcagtgaacagtcatattttgaaaggcatcatttttttctgagcagtaggtctcaacggtggtcttaaaatttccaataaaccatggtgtaaacagatgtgctgtcatccaggttttattccttttacagaacacaggcagagtaaatttagcataattttaagggccttaggaattttggaatgataaatgagcattggcttcaacttcaagtaactagctacattagctagttaaaagagactcagcctgtcctctgaagcttcaaagccaggcactgacttgtctctagctatgaaagtctgaggtggcatcatcttcccatgcaaagctgttttcatctacattgaaaatctgttttttagtgtagtcttcatcaatgacctcagctagatcttgtggataacttgttgcagcttctccgtcagcacttgctgtttcacctggtacttctatgtcatggaagtggcttctttccttaaaccaacttcttgaaccaacctctgctagcttcagatttttcttctgcaatttcctcgtctctctcagccttcttagaattgaagaaatgtatggccttgctcgggactaggctttggcttaagggaatttcatggctgttttgttgttattgttgttgttgttgtttgttttttgtttgttttttcctatccagaccactacaacattctctgtatcagcagtgaagctgtttcacttttttatcattcatgagttttcactggagtcgcactttatatttcctttaagaactttccctttttattcttaacttgactaactttggcacaagagacttagcttttgacttattttgctttgtacccgccttcctcactaagcttaatcatttctagcttttgatgtaagtgagagatgtgcaactcttcctttcacttgaacacttagagaccattgcagtgttaataactagcctaaagacaatattcttgtctcagggactagatgggcctgaggagagggagagagatggggaagcagccaatcagtggagtaatcagaacacacacaacatttattgatgaagtgtgcagtcttatataggcatggctcatggcaccccaaaacaattacaatagtaacatcaaagatcacaggtcaccataacagatgtaataatcatgaaaaatgtgaaatgttgctataattaccaaatgtgacacagagacacgaagtgagcacacgctgttggaaaaatggtaccattagacttactcgactcagggttaccacaaaccttcaatttgtaaaatatgtgatttctgcaaagcacaataaaacaagtacaactctatttcctgatgaattagaggagaagagtgacagcgtgggggagtcaaataagaccaccaagggttttgtctggaataacttgaagtgtcagtgctgccattgactgagatgggaaagactgcagaaggagttaattttagagttcaggagtttttatttgaaactacccatttatttgtttatttatttatttactttttaatttattttgagatggagtctcactccgttatccaggctggagtgcaatggcgtgatctcggtgcactgcaacctctgcctcctgggttcaagcaattctcctatctcagcctcccgagtagctgggactacaggcacgtgccaccatgcccagctaatttttgtatttttagtagagatggggtttcaccatattggtcaggctggtctcaaactccttacctcaggtgccccacccaccttggcctcccaaagtgctgggattacaggcgtgagccacagcaccctgctgaaactacccgtttacacaatctagtggaaatgtcgagtagataatttcatatgtgaatctgaagttaagaagggaaagagagatctgaactggaaatgtaagtataggagatgtcagcatataacctgcacttaaagcctcgagactacagtgttgttcaccaagggagtgagtctagaaagattaagaaagaacaaaggctgagccctggggcaacattaaaactgtgggaataagaatcagtgaaggaggctgaaaaggcgtggccagtatagtagaacaatcaggagagaacggtgtccagaaagccaaatgaaggaaagtgtgcaggcggagaaagtgagaagctgtgacctgatgggttcaagtacgataagtcccttcccacttttttgcagtttcacttcctgatgtttgagttcaactgcagtcaactacagtctgaatatattacatagaaagttccagaaataaacagttcatgagttttaaattgcacgctggtctgaggggagggatgaaatctcactgtccagctgggacggtgaatcttcccattgcccagcgcatccacgctgtgtgtgctactcgcccctgctgggatggtgaatcttcccattgcccagcgcatccacgctgtgtgtgctactcgcccctgctgggacggtgaatcttcccattgcccagcgcatccacgctgtgtgtgctactcgcccctgctgggacggtgaatcttcccattgcccagcgcatccacgctgtgtgtgctactcgcccctgctgggatggtgaatcttcccattgcccagcgcatccacgctgtgtgtgctactcgcccctgctgggatggtgaatcttcccattgcccagcgcatccacgctgtgtgtgctactcgccccttccatctcgatgatcacatcaactgttgtggtatcacagtgctggtgttcaagtcacccttattttacttaatgatggcccccaggtgtgcaagtagtaaggctagcaatgcagatctgccaaagagaaaccacaaagtgcttcctttaacaccggatccataggatttggtaataatcccagtttcaggcatctactggggtcttaaaacttattccctgtggataaggggaaatgccaccgtaaaatgaaggcttaaaattgacgttgggatttagcagcatggagatcttgggccatcttgacaaaagtgttttctgtggaatggtgatgataaaactttcattggatttaaaggagatgagagtagaacatttagaaacatccagcataggcaagccctttaaggagttttcctaaaaaacagtgaataaaataaagaaagtaaaataaaataaaacaaaaaagagggtgtagctgatagggaaatcaaggaaaagccccctttccttgcctttttttttttttttaaagatagaagtaataactacatgcttgggatcatgggaatgagtccataggggccaaaaataaatgataatatagagcataaaattgctggtagcaaaatatgacaatgcaatttgggggatttgaaagcgtatgtctaaaatacatatttaaattaacaagtaacaaagtaatgtctactctaattcacccttttcctttgcatcccattcaaaattctgacccacttaaaaatgataccagataagtatttgtttcttatctgattaaaacaattagtactaaaatatgtatcaggctgaacatcccacctaaagtccatattatttgtacagatttgcaataaaatgaatctctaattggaagatattttcgagtggcattttctgaccactcgagacatgactcattccatatttagtttttcagagagtaagtaggttgaatcagcattattatccacagtcaaaatgccccaaagtcaatcgtagatcccagagatgtacaaaaaaactttaatgtgaaaacaaggtcacacttctccaccacacctagggctaaacccatttccacctgtaagtgatgcagagcacagtcatcagagtctatttccacaaaacaatagtctctttgtaacaccgaggagtcaggctgaaaacagaagttcggtgctttagaatgaagaatgctctggcttgggcacagatttagacagttggattcagatgctgcttactgaagaactctcttttggtgaagcaaaacatcttcaatccagaagtatgtttagcctctaacgtgatcttcttgctgtgcccatgaaaacctactggactctgagccagacttgcctgatcctgccctatatgcacatgtataaaatggtggtccttttctccttctgtctgaatcacattgctgtactatgcattgattcaccctacccacgaaaagagttgaagtgaaaaaagaaccccaagcaaaactttgtctggctgactatgcctatggtctgtgagtcactaaaaattttaactatggacttgaccctactgagcccaggcaagcccaagaactccccatccccaccccatcctcaacacagagactttcctgagggactggagctagcatagtacatcacattgcatagccacaaatcaccaatctacctttgcaaagtgtggccttcttaaggcgtagcatgcatatgtataaatgcatatgtggtatttaacacaggttaatgagatcaaccccaagtgagctttctgtaggacatcatatactgcaattatgataaagttatgttaaaatatagggactttccaggtaaatgattaaataaaaatgatttttaaagtatttatccacatgagctgccttctacatatttcttaagaatgtatgtgcaaagggttaatattatatgtaaggcagacatctaatggataaatttaaaagcagctaaaaacatagcatcctgtgtataactttcataattgtacgttcctccagagataatggatatgattatcagcagcgcctgtcctaggtaacttggcaaggttacgattgtttgttacagctttggttatattaacatacacattaatatttataaatatttgatgtcatgttaatttttcatataagatgatttatgtaatgttgctgtgccctgttagagggcatttgcaatatgcttcaaaagggaactgaactgatgcatgttctttaagggaacttgcctgtatatcactgttctcatgatgcattattctgaacaatagtatttcaaaataaattatgtgaattgtggatttactccattaacattttaaataaaacataaaggaaaagatcatgctgaaactatttgctacatttttaaaaggagctctgttctcttggagcagaacaaagtttactgaaagactctttttcaaaaatggagttatcaagcaagcaatggttttgcaattttgttttcaatgtatagtctatatagcatgcaaactagcatattcagaaaagtatataaacttgagataaaaaagtcataatattcttgttttcatttgtcaattttcttttgctaaagtatattttactgtgatgatcaaatttagacattaagagaattaaatataaattcagcaggatgtgtataataaataaatcaaaaagttattaaatgaatatttgctttaggtgaaaaaaaatttctttataggaagtttaataggtttgtttagtattatagtactactttataatatagttcattggtccacattaccaaataatattattaatgatgtttcactttttttgttgttttggtcaaaaggataaaatattttatgtaaaatctgtggaaaaaaacgcagaaaccctattttatatggtaatccattttccaattttaatggatgttatcttatcctttttttttctatgtaggcattttttttgagtatcttcttgtagttatgctattagcatatgaactattaataaaatttgagttttgtacttgtttctttctttcttttcttattttttacttttttaagagacgggtcttgctatgttgcccaggttggtctttaactcctgcactcaagtgatcctcccactacagcttcccaaagtgctgggattacaaacatgagctactgatgctgggattacaggcttcagccaccagcgcctggcctgtacttgtttcttttcaacagttttaactagtgcttctattgttcctttttccctattaagattcaagttttctttaaggtgaacaattccttattaacttactgttcttttcttcgtgtccctaaaatgacacatcatcctgcggtataacactaagaacgaagttagtaaatttgagaattttggaaatcctcatttaaaatacacaactggaattgaatattttctcctaaatttatcattaaataggtaataattgttacttttcatttcatcactggcactgtattaaaccctgaaacaactcaaaaaatcaacttcagaaattacctttgatttgacattacagaagttggtttgttattactatccagtttcacaacattgacaattaacttgagcaaaatgtaatagacttttttctctcatatttttcatactcaaattaattctgtcatcacaattattcacattccaaaaaaatttaaagcaggtcacgagggaagaaaatgccttaatttgaggccacgcagaaagatctgtggcaacaaagcatgggaaaaggcgggaatagggttacatcctgaagcaacagacagctagcgctgtgcaaagtatatgactattaagtcgttttaaattcacataatatcatctgaaaaaatgttgctaatgcacatagtcacaaacagcagtcagcagtagatagattgtgttaagtataaatgatttgaattactacctacatatatttagcttagaatatttataatacatacatggaaatctatatctcataatatataataaaaggagaaggaaaatgtgagaaacctggtatttttagagtatcacaaatctgtgttgtcaaatatgaatcaatttactcttcagaattcctgcttcctgaatgaagaagaatcaaatttagaaggcgtagtattatatatgatcaaaatgttacaaagcatagtaactgaaattattaaacatatcagcagaaccacctggcttgaaagactataatagatcacccatcaagaaaaaaacagaaattaaaagctttaggtgtcgaaggataggtaattaggaaaggataatcaaagagtggattccacaaaaaggttagtgctgtactttttgttgctgaaatcagccttttggcaattgatatataagtaatcaaattaaaagttttccatcttacactgattcttttataggtaaaagtatgcattaggtaaataataaattaagaaaaagaaggtcaatgttcaattgcagtgttttaaaagcatcttccttaagattataagcacccaagagacaattagcttaaaactataacactatagtaggagaaagagatctaaatacacagacacacatacatacacaaatacataagtatatgtgagggtatctccaaatacagtatacaaatctatattgagttggctactattgttcttactgtaaagtttctaatgtagtcataaaattacaaggaagttaaaacgtcagaatagtttaccactccaaattagattgtgatattttatctaaatctaggcaaagccaactctttttaaaaatactcttcagggagagggtagtctcagatatcataactacaaaaataatgtgcaatttaatttaaatctagatttttatatttagagacaatttagttatcgagttaaagaaattatgacatttctaaataaaggttttactgaattaaaatactatacggcaaagtaatttgtataggtgaacgtgacacaaattccattagtggtattgtcaccaaaatttgatatctaaaaagaaaactcatagcagatcaatactagtaagataaatggatcaaacttacacacatacaaatcacatttctttttatagctgattaatacttagcaatacataattaacagttacaaaaacattgtactatgtgtttaagtgacagtgcaataaattaaggcttcacatcaaaccccatgtaggccacttttggaggtgtctacttccctagtcagagacgttaccctcagtcagtgtgcacattttcattaccaagtaaaagaagtagttgttgaatgaactggaatggctcaacataacatattaccacaagaagaaaagaaccatttataaatcctgatcctgtatgccgttttttttttcatctttggatctggacagttggtattagataaatgtttaagacaaagccgaacgattttagcatcatttcacacaaatcattacattatatttattttgaatttttcctacgtaagctgaactagaagaaaataattggttagataaatgaaagatattaataataaactctaaccctctaaagtttaaattctatctcatttgattctcttaatatcttaagagaagcagatagaggactattacttcttgtgtggcagatttaaccccaggatgacatgaaattgttatttgataacagttcagtttgttggtgataatggtgacccttggtgtttcaagtgggtttttggccaagtcatctgcacaagtgaatctaaactaattatttcaatagacctttcttatataaactgtgttaacgtaaacactgtagaaactctaaatgtagtgggggaggttggggtgtgcagaacagacaaagagattgctttctacaatttaaccctgaacatatggcatgtccatacatgtaaaattaatgtgcccagtacaagcaatcatttcatagtttatcagtgattgcagatcacagcaaaatacgtttcgccacactactatggatctgttagaagataaacctaaatggataaaatgagctcaggtcatagttcatttttctttctgtttatgactatgaattttttattttactaagtcttttgttaaatcaaaaacctcacccacgattagcattgatttattttatgttcattttagatttgatattagcgtttttatcatgaatatatcatatccataaagaggcaaagatactgggtttaccttctgctctggtttcagttatttattttaaatgctgcctgtaggaagagttaagggtaaccattttagggttaatctgtcactgcatgattaagtatgaaaggaaaccattcaaaagtcacaagaatgaaatgtaacagaatacacaaggggtcaataaggatgtgtatttttccttccactgtgatctactgctattcagaacaattgattagacaggttcattattgttttgcaaccacacataaaccattattatctgccattcactccctaaggtgttctagtggacagtttttcaatgatttgtaatttcaaatagcagcaaacttacaattcaccttgtttaacttccctggtctttcaaagaggattaccaacttctacaagctaaacattggagcagttacagccttcctggaaattttttatcaggctggcaaatgtttatcatccctgaactatactcagtccttaaaacagtgatttttactttatcctgaatagatgaataatggaggagggaaccacccttctggagctgaaatcttctgtaagtctagccttcaaccatcattcaaaaatatgtgctgaggtttgcagtaatgttatttagagaaattggtaaatgaattataaaatgggttataggccgggcgcagtggctcatgcctataatcccagcactttgggaggctgaggcgggtggatcacgaggtcaggagttcaagaccaacatggccaacatggtgaaaccccgtctctactaaaaaaaaaccaacaaaaattagccagacctggttgtgagtgcctgtaatcccagctacttgggaggctgaggcagagaattgcttgaacttgggaggtggaggttgcagtgagctgagatcacaccactgcactcactgccacagcctgggcaacagagcgagaatctgtctcaaaaaaaaaagtgttatattaggagcaattttcctgtaaatctgtacaacatataaaacaaaggaagatgagtaaagttgcttggaacaggacctaaagttttgtcaagttcaatttttttcatattataaaatgacttttctcaaaagcagactcaagcaataaagtattttctttgtggaattcacattggcgtgtatatgtgttcttaagaggcattgctctttcattaaactctagttcatagttctgtgtgtgtgtaagattttatatgggtgtgactaacatgatcagagcaggttctattcctcctagaaatatgtgtcattcttagtgtttgggctctggaaaaagtgtaattaatcctggctcttctacttacattgggcaaattacttacttttcaatgtactgatctttaaaatgaggaaaataatagtaacgacttgtgaagttgttatgaggaccacatgagacaatgtatgctatgtggtgggcacgttgtctgcaagaaaacatgcgtgtaggccaggcgagtcaggaggaggagggaaaataggatgcagaccaggtaattgcagtagtcaagacaacatcaaaagaaagacttgtttttatgcttttcccactacttatcataaggactttaaatctgcaatataagagaaaacagggtcacgtccttaagtgtaatcacagtactttgttaaaagtcacatccttcagagacaagtcattgcaaaagaaggaagtgaagatggcaggatagtgataatgctttatgttaaaaattgaagggctttcggcatgagcaatgcttatgaaaaccatcctagaaatagcatgggatgctgacctgtcaatgcctagcttccaaataaagctcttcattttttttgatatatttattcgggatttctattaaaggctacacaagttgagttagtttctattccatttcacaagagcattctttaatttctgataataaatagaactaatacatatttaaaggttcatcccaaaatttatataattttagaatcgtatataaaatattaaacaagatagccagcaaaaatttgtacacagtgttccaactattaaaatacatagaaaatgccatctcagtttataacatttattttacgactcttagaaaatataatccaaaattgaattttgaagtgtcactgaattttcagctggaatttcttctggtagatactctcaccctcttcgttttgtgaattttgatttctttcttaaatgggactgtgtcagttctgaaaataattcaatgacagttttttgcaacaacttctttttaatagggaaatgttaaaactgaaatatatatttactttatgaaaaatatttaacccagggcaatatttctcaaacttccctttgagtaagaatgttctggaagacttgtttaacatgctaatttattggtcctatccttggggattctgattccctatagctgaaatagggcccagaaacgtatatgttctcaagaaccctcaggtgattctgcttacagggggtctaaaggcaacaattagaaaatcattggtccagggttaccatagatagttagagcatatttgtcatcaagataatcttcaaatttcaataaggaacctctttattatcaacattattccaaaaggtagtaaaggttgatttctaataagtttgaaaataaatattgcctgtaccatggcctgatttaaatctagtttctaagtcacactgtaaactcttgaggcaagattctagtactcactgatcagtgtaaatagagactgaagataaatgcagagctccattaagccaggactctaagctaggaatctcacatgcaccctctcttccttccagcatcctcttagtttatcttcagtttaagcttgttctcccttctctttcccctaactcagattctctcactgccaatttcctccctctttatagactcttagctcataatcttctcatggcctacttttttctcctcctagatatcttatccaaggataaaagaggggaaggtgaatcctggtctttcacagattttgtggattaaaagtgctggacttggagtacagggctaagaaagaagtgttaggtaaacacagaaagaaatttggatgcttctctgcccaggccagattcttctttcccccagtctgctctagaaatgcctggcttcttatgtttttcactaaagcaaacaaagccagagctacgtcttcatcaggtaaactaaaaatcagatcacatggcccgtaggagcttgctgtatttcaatatgactcttctactgtttcatggctttattccacaactctcttttctcagaaatgcatcacgccacagagaaaaccaagctctgctgtcttaagcaccaaaaatgaaccaaagtttggccaggtgcagtggctcacacctataatcccagcactttgggaggccgaggagggtggatcacgaggtcaggagattgagaccatcctggccaacatggtgaaaccccatctctactaaaaatacaaaaattagctggatgtggtgatgcgcgcctgtaatcccagctactaggaaggctgagggaggagaatcgctggaacccgggaggcggacgttgcagtgagccgagatcacaccactgcgctccagcctggtagcagggtgagactcggtctcaaaaaaaaaaaaaaaaaaaaaaaaaaaattccaaaaatgatccaaagttttaggcaagaggatagctttacctagaaggttgttagaaatatctttctttgtctcacttgggacgtttgtaccctaagagtagtggtgtttctggtgtcatctttaagcaaagaaagaaagaattccatgacccatgtgatgatggcttaggtttccagactaaggtaattcacacaactgtggcctaatgtacttctgacatcaggatttatggatgaaccaggtttagtctcttagaaaaatcagctatgagttgaatacagacttgaagtgaaagtaaagacgaaatatcaaaatatcaaaatcttatgttgtattttaaatttctaaagtcttaaggaagttgtctatgtccatttcaaatgggtgtaacggtccatgacaggctttgagaaaatagcatatgaccacgaacttcgtcgtaagtatgttgttaagagtggcggtggtattgatgatgtaaacatctttcctctcctggcattaacagacagaaatgtgacttgtagattcagtttctcccaaccaacacatatgtaagaagaatgtgaaactcacctctctgcttacatatccttagttgatagttcacagacaagaagttttgtgagactgaaccctaaatgatctgttaatgatttgggattttaaacagtttgctctgaaagctggttcttgtaatcaagtttgacatgaaaatagtactgtcattaaattcaaggaaataccacagtttaatgcttaatcacattaaatttcagataatttgtatgtcatgaagctgtattttggaaacatcagttggagctttactactgagcagaccatatatctacatagactcttagtctcagagcactacagtatcaagttgtagttttggaaagctggtatggaaaaaaaaaacacctgtttattaattgcattgaaatgttttagggaatacctccatgtaattaaagtggcaatgataatgaataatagggctacaattactttcttctagaaccagcttctttctttcaagggaaaaattcttgccccgtcacttgcctcatgaatttccaggagtgttccttgcctctgatttgaagcatgctattgttgttcttttttcaagcagttctgattctttgtcctacacatttttgtgtatagatgttgtctgggtgatggaagggtagagattaaactgaatttcttgcagggtcagtttacatagtgagttctgaaagggctgggtggaagatttacattttcaagcaaaatcattgaaattacggtgagtaaaacatatgataaggatattaacacatacctaataggtcacccatactcacgtgggagttttagtacttcttagtaattccatttacttgacacaaatggttttggctgattgctctaacctatcaccataccttgagcaaaacaactgatgtcattcaataaggagttaggatccattaaagagaagcccattataacagcttatacaatctacaatgcaaatgagaacactgtttcaacataagatgaaaaaggcattctgaaagaggctaaagtattttctaaattttaaaaaagagctagtcttgacgcctaagatttcttaaatatttttcaaagtgtcaactcagaattgtggaatctgtcttttgtcttcccactgtaaggattcaaacttctcataatgcacagaaagatctccagtcagcatccccccccacccaatacaacgttgtgttaaacttcatccaattgtccagctaattcttgtgcttctccaattttactggatatgatgtttttattggggttcatggaagcatggctaatgacatcagcaagctttgtaatttctcactgccagttttctacacaacttacacttttgtcactcaaactgcaccaaattgctccaacaattaatcttaaagcgcaggagtagggggacttttaaatggaccccttcttgggattttgtgttaaaaacaggaaagttcccatgagtgaaggggataagttagcttttccagcctctgcctctccccaagtctcactcttctctgccacctccccccccccaaaaaggaatgaattacatttctcttcttgtcctttaaatgaatagcatagtttgggtgaaattatcaggcaattgcatgccttttatgcagataatgctatttgatgaaagcggtgttttgatctgctaaggataatacagatccagggttggattcattggtgagagtaaagctgtcttctgtgataacttcatctcagcatgaggtcagacggggaaaactgggatgggggattaaaaaatgacacagtcggagcagtattcagttccctgctgtgctcctggctgcacactatagcttatgtttctgatctgttatggtattgtctgcctttctctctcggagcagaaagagattgcttaaaacttttcttttttcagctagagggattagttctgtgcagcttttttaattaaagaaactgtatctttttcaaggcaatttaaagctgcaagggaagacccatcaacatccataacttagtactattatctgtaacaaagtctaagctctaaatttgatattcagaaataggggaaaggagctatagaattctgttgtattcttaaccttcagtggttgctcaaatccctaaatgaagaatagtaaataaattattttgtgtaagtcctgaatatgtttctataagtagtaactttcagcctctttgctttttagcctagctgagcttgcttaattaaatcttcatgatgatagcgaagtgcacttgcaaatggtgtaagaggaaatagatttgactatatatccttttctttacccagagatcatttttaaacatttccattctactgaaagtgataacagtagaaaaggtctgcttaatatgggcaatttgcatttaaacagtgcaaagtacaacattatggtactttatcacgacgaatctttgcatgtgtgataagcggtcatcatctttattaatctgagggaagcatggattgaatctatccaaagtgatgatgaatttgtcaggacatatacatttgagttgaatttatagctcaatttaacccaggttaatgtcgaaaatcctcaaatgtttcaaataaggcccatatggttatcactttacaaagcacacaggctctgcgcttcagttgcaacatacacatctccaactaaattccatgccagatcaattagaaacagtcctcctgagcagacaggaacaaacaaagattgtttccccaataccagctgaacccttgtcttgaagaaatgaaaagcagtcatcttaggctctacacttcttaccactaaaaatccaaagggaatttggaggacgacagggttttataaataatgtcatatttaatataaaaacatgagtatctacatgttataggtgcttgctacaatttgtttccaaatttcgataaacatcatatcctactgaaaaagagaaaaccaaaatttgatctctttgccttttctcattgtttttgtctttacttcgcattatgattctgagaaaagtcaaccaaggtcaaaagtggttcgttgtaatgaccagaattttaaaacgatgtcccattaaaaacttcatggtcagagaagtagaacagtgtacttaaatgcattttcaaggtaaattttatttatgacatacccctgtttaaaaaagaaagtcagaggggctaaagacaatgaaaatattttattcgtgtatccactcattcgttcaacaaacatttattgagcagctcctatatgccagcccatgggctaggcttgtgtgtccaaagaggcataaggttgagcccctacactccaagagtgctcagctattaggaaagacctatgcaaaaaacagtgccatcctttattacatgcagaaaacacagtggaagcactgccaacgggaggagagtatcactaataggtactttaaaaactatgtgttccaggggccccggatgcagagcattccagactaagaggtcaccaaagggaggagaaagagtagggcacttctgggaaataaaaagatgttcaatttgtctgatactgaatttagtcacttgatacctatatttttaacctatatttacaagttaacatataagctggaccctgaaatatctaacgggtgttgtttgactaaaaaattgtcctgtagtgtcactattgtatcataaaccttgccagcagctaatgcctacctcgagtacactatatacgcttctcactgaaaagttgtttatagaaaatatgacagatgttaaaaggcactctatgataactcttaaaaaggttccaactttcactgtggaataatgtagcaagttttaaatacgttcacagagctaaaccaaaaccgaaagttccacatgttaaaagacgctggtgttcaaaatccttcgcaaaacctggggtcttttatgaggctctagccaaagcaagggagcccctgggtggtgctacgcaaatgcatttccaccgaaggtcggagccacgcgtaaggcccggtttacaccatggaatacaaacgaatgtactggagaagcatggtcccaattaaaggttgcttcgtctcatcaccagtccattcagtggctccaaaatgcatgcacattgagagaggcttatcttgctttaattaagataatgaaagcatgttttcctctacaaacagtcattgaattttatgactttgtcagtgatcgaattaaaatatttgttttatagttccctcaatctaacagccaagggataagttatttttttgccagtggggggaaaaccccacccaataataactttgtctacttgagagacttccatgtaaaatttaagttttagtgttgttcactgttgcagattaattgcttgctacctgtgaaggcacttgtgtaagggaaacacctcaggtgcctagaatttgggttttgctcagtggctaccagcctttagcctctgttctaaagtggcccatcacctatttgctgttctcagttgagacataagctccttttgggcatatgtgggttattggctttcctgagcctgaggggtgagctggaaggtctcggtacctgagatttggctcccctggtcatttctaccccgttcctcatcgttcctagggtctcttgagtgggagaggttgcagccggggcagcaactgggtttgaacccagcagacaggccgctcatgcctccgtttgctaaagcagatgtaataaagtccaaacaataggtaaactccagtgatgtccacaagtgtccttggagagcctaatacctgcctgacccggcggtccccttctgcacgcctgaaagcctcgcgtgttaaaggaggaagtggctgcggagaccctcgagtctgcacgggcaagaggcacaaacagctgctacccggccccttcagttccaagctggctctttaggacaggaggagaaaacggacagaccccaaaggggagaaagggaaggcgcatgtgatgctgactaaaatggacaggtgtcaccttcaggtgggcagcgacactcggctgagacttgacccgcggggaggcggtggagcagcagggcagggtgctgttggccttgcctcagtagtggggcaagaacctgtctcctcttccccaaaatgaatccagaggttcggcccattatatccctcccccccgccccccagccctttgagaggcttccaaaggccccaggcatgcattcctaggactagggctaggcgagggttgctgggccacattttccttttggagagctgcgcatctgtgtggcaagaggggcccacgggagggcgatgccgccagctcggtcccattatcccgagcacgaccggctgcgttcacaccgcaaagtcaccagccgcgccgggcagagtttgctgagagcggccagaggcttgcaaaacagacagcgatgtcttgcatttcttctcccgctccagtttttattgctgcggagggcacgacgtgagctgcccgccatccccgccctctcttgacaacagctcagtgaggtaaaaagcatgatggtcacgtagcgagctgcctctctgctttccagggattcatccgaaggaggaagcgtgtggtagtttggcactgcacaacatcagcttttcctaacggcctcaaatgatggaacttctttgtgtgagagacagagagagacccaaatttaacacacgtaagctgcctggattacaggcgcaggcagacgtagaggaggacccctgcgcgctttgtccaccagcgacgcctggcatagagtgcgcagggccgtattaatgagttctagagtatttttttctattttgcaaccatagtgtgaacgttcagcattgcatactgaaaaactttgaatctcatgtaagaaggaactgggctagagacaggagccaagatttattaccatttctaagttttatgagttctattgttttcctacctttattaccagcgttagctgtaatgaggattctagaaaaaagagctggaaaaaagaagcatcccctaactcacacaatgtagcacttcagttctggcctctttaggattggggcagtgtctcatctctttattgtgtattcgtagacagtaagagggagtctcacttactacttggaaaagttttaaagacctaatacttttgtgtgtgtgtgggaactaggccacaaaagtgctttatgaaagagtttccttacgatcatgtccggattcaaatttcaagtagtttgcatgatcttcatgtaatatctgggacacaccttcataattgacaagccttttttttatataataataagaatggctaaatgagtgagggatatcattcatccgcccccatgaccttatctttttcaagtgtgaaattcagtggcagaaggagatggatctatcccagggcgactctagattcttcccgcaaagatatgcgtgctgctttccgtcactagcgccccgagagccgggtcgggttcgcttactaccaagacttctctacttaacgcgctgcgctcgggcacttagcaacttcgggaacacgggctgtgggtctgggcacaccacctcgagtttagggattctcctcacttctagcccaaactttggataaactaacataaaggttcaggctttcctaggaggcgtcgtccttgttctcccagtgctcgatctgtttctggttctgcacggtagttaaaaatgcaagtggatttcctaacggccgagtacaggtacaggtggaggtcggcggaatcctctgctctgaagctgaaagtggagggtggcgcgaggcggctggcgcgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccgcactcactcggcagccccaagcacgcacgccccacctctgccgccgccccgtcccggacccgaaaggagcctgaaggatcccgccgaccacccagccagagagcggttcggctcaggtcgcccattcggagctacaaaactctggaacctccagcagtttcggaagctccgggggagggctttcctgcagacagggggcgggagctagggagccgggagccagcgctgcggtgggaacttcagtgagtagaaagtggccagtgtcttgggaggagcagcaaactttttttttccctcccacagcaaacaaaatcgaggcagggacagtgtccggccgctaatctgaggggagaatggagaggaaagaagagtagtaaaagtggggagtggagccttcggaggactcccgggtccgcccctggccaggtgatgcggggcggaggcctaggtgcttgaacctggggggcagacaattgttctgctgcagtgcccaccaggggctggtaaggaagtctgagtgtttactgcctcccttccctgtccaaaggtcatttgcgcttttcggtctcggacgaaagaacactgtggaaaggaaggcgcgggtcattttcagaggctctgcaaaggacgggccgcctaccgggggtggaaatccttaattacacccttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacctggcccttctcgccttcctcctccctcgcctccccggtcctcccgctcgcgggctgaaccccgaaaactccggcccggcctggtccgccgccttggaggaggctggaggggccggcgggcggggagagggggagcgcgggggagagaaagaaagtgaactcattggcgcgcgggcgccctcccctcccgcgtccccgggccgcgcggccgggggcgggcagggaaggaagttgtaacactcgcgccccctccccgcccccgccccgccggcgcccgctccccgctccctcggcggggcccccctcccccgcgcccggctcctttgaatttggcccggcgcggtgtgcgcgcggctcgggcggacgcggcggctgctgccggggagcgagccggcggcgcgggcgagccgagcgcggtaagtgcggcgccgccgccggcgcgccctccttcctttatggggtcctagtgccgggccgcggcgccgggagctggcgggcgcgagctgggacggcgcgtggccccgggaggcggcggacgcggggacatcttctcagcgcgcggattctctccacggtccggcctccccgtccccgccccgccctcgcgccagccacctccggccgccggctcaggtgggaacttcgccggcgcctctcgcccggggagccaggcgccgcgcccccgtactggggagccccggggtccctgaggaaggcagtccggaggctgggcgcccagtgggggcggggaggggagcccgccaggtcctcttcggcccccgatgtgtggcgaggccccgcgtcttctgcgggggcgtcttaacaggatcctggggggcttccagcgagcggaaagccccgggatgtcaccgctttccggggcaggcaggggacagaaggcttctgcagcgatcagggagccaagttgaaaaggagtgaaggagggagagtgcggggcgaggggtagcgtggggagtggtggatcacggctgaaacttgatcgggaaactctggatggggttggaaacacacacaaaatatcctgagctgggcgtttcaaaaattacgaatttatgagcctgcaactgagattctaagtccctctcgtgttttacaaccgattacaaagagcttcacgtattttaggttgaggcgggttgtgtctgattgatctttgctgagcatcttactatgcagcttggattccattcttactgcctcacctttaaggtagctggagtggtaacttgttaatttttattgtagagagagggtaacaagtacttgtaccgtgtaatacatcacacacgtgtgtttccccaagtcactgtaatttggaggtagagaaaagtttccaggtacgtgtgaggaggtgcaatggaaatgaaaggctgagagctgtcctagactttttacagggccccagacggctgggatgcccgagaacaggactgtctcttcatcatgctctatttcttatcttctgacaatgtattttgtcaaacattggtagactctggcagaatccactgggtggtcttttcactagaaatagacatatgttgaggcattacctttcccttctcttgtcaaaagaaaaaaggtggatatggcatctctggaaagcttggaagagtatcccaaaagatggtattgtaactgaacagaacttggtgatttgatcccttagtgaatttctttaaaataatgacgcatatccctttttccccactgcctacttggagaagtatttgtagtctttatgtattaatatattgagaacagactgactttagaattaagagcaactgtgtaataataattatctattttaatatttcaattaaaacaagattttataaattcaacaatcttgctttgtgcattccttaatacacttttaattatctaaaacttcgagcatgtatatcttaatatataaaattcttgtatgagccctgaaagtttggatttgtaattctaaatgcagagtaaatatttaattcttgatctaagagtgagaggttagttcagtaataagacttgctaatcccactttaaaatgtcatggcattcacaaattattcctaaattcttcaaagataggagtttataatgagtttagttattctattgtgtatttcaggattgtctgtatctcttcctgttgcatttcccttaacaatcttgttctttttttcttacacgaattttattattcctcttaatcaaagatttttttctaatagtaaacaaatatatcttatgttaaataacttagaaaagaatagttagaaaaagtagttcaaatcaaacacacattttacatgcactgcacagtttttataaaaaatgtagttgtactaatcaccatgctaacgtttatatatttggaaaactctgtgaaccccctgtgccaatagctttatgttagcaacctatgcaccctaatgaggattacttgattattgggaataaagcagatagatttatggaattgtgactagttattcctccaaacgggattattttgcatggctgtgtttattttctagaaagatgttttaggtaaattattgaggcttttcttactatgattctgtaggcgtgtcatcagtcttttggttagaaaagggaacctgccttattagggtgaagacaaagaaagataaggatgcttatctttgaatagaaaaaagctcctaaagagagtgaaaacttttaaacttattcagaaaggaaacctagctaaacaataatgatccagttagtaagttcaagctactctttcttagctttgcttctgggagccaagagtaattattctgtttgtaaagagtcaagcaaagaagatagcaggaagaagcgcgtggctatcgttgtgagtagagtgacctgtcagaaatactgaatcaccgttaggctcggtgtacaaaaaatgatgtctttgcaatagctgttaatgtatgtttggagatgctgaagtttatcctacctatagggatactagggaataagttcagagcatggtcattgtctgatatgaaagcccaacaaagccaagtttattagtttattaatattggttatttaaataaatgcatgtgcctcctttttattaaactttattttaccctgtaaaaatttgatttctggatggtggttgaatatcatccaagttttatatttatttgaatcagtgtgttcagcagctgtgatgaattgtctgcccttttctggaagctgtgcaacctgttaagcatgttgaattacacattgctcatctaccctgtgtttcgtttgatagtcagatatccgtttggacttcgagggcatacttttttttacttaggttgagaatatgagcaaagaatataatagtttgccaccaaacgtttaccgtggtccataaccaattacatattcctttaaatttctagttgaagttagtgttgtgttcatagttgccttgtaaagtggaatgatagcccgtaggaaaattgaacacatgcattcggagtaaagtctgttgaaaagataacacaatattacgttatttaaaagtttcgacaactaagttttaaaaattattttacgtaagcttcttttagaatacatttaaaacttatttttggaaacatcagctggtttaacagacctgatggaaattttgtgcttcaaaataaaataaaataaaataaaccttagtctgaaaactaattgttgtgtcttataaaacctgatttattttatacttttttataccaagcatgaccattatgaagctctccttctaattgagattaatgtttctgagcaaagaagtggtttggagggctgcgttcattttgagtgctgttgtaatcaattttagatacagcattccacaatggatcagtttgcatccaaacctgccttattatgtagaattaacttgttggtgattgatagtgatacttctccatcttgaaaagtcatttgtttccaaacgagtgtgatggcttgtatgagtttcaaaagattgcttctcataattaaaacatcctattggggacctaatttgaactttttctaagaattatataaaacatgaggaagcaattcattaacatatattcaactcaaatagcctattttcccaaaatgcaatatgcctcaaggcatattttcttgcccatcaaaggattttatggccttttgagtcattaatagtaactgtaatccatctaggttatttccttttttgtttgtattaacattctagttcagtttttcagagatttcttagaattttggatggacctcttgtgcatgtgttataactttatttcataagatggtgtaatcctgacaatgaaagataatgcatgtggaggtaattccttaatggaaatgtgaagagatggtgaacgttatcatccccactgtgatatttgcatttgtttcttatctgtacctggtcatctttggttttatcagcttttaagtctcttctgaaagaccactttaagattttcttgggctttggttcatattgcattgtgatacatgttgtcccaatcaaataaaagattaggagcacagaatataagattaatatagattagcattctaatatatccacagtatatccatatatatcaatatatatccatatatatcaacgtatatccgtagtatatatgatttctaaagaaagatgtaactgctttctagtgcgtgtaaacttcccacaatggcattactctttactttcaggaaggaaaaaaacttgataagaactatgtatctttattttattctctgtaatgatagattcttggcatcggattggtgtttttccagcttaagacatccatttaaaatagttttaaatgctaaaataatgcagttaaattaccattttcaaaatgttattttacacaagtgctagagtataaactatcaaaatgcagaaacatgccctgagatacacagatgtttcgtacactgaaactacaataggattcattcttttgaaggaattgcaataaaattttctgtagttttggttaaataacccaggtgattgcctagctagaacagctacatggaatttactaaaaatagtgatctactcaaacccatgtctttctattttaaattagtcactgcaaattaatgtcagtatcatagaatgaactcataagtcatatgagtggatgactgaaaccatatcatgtaataataataataataatgagattttacttccctgttgataactttcttggaatcttggaagagctaggatcgggtagcactgacttttcaaacaagtttgtgataggtggcagtcttaaccgagttccttgacttccttcagaaaataggtaattcttatatgtttaggagcatgtgtggagtgaaatgtagcataacactaaactatgcttatattcttttttgtaagtttaggagtcaatcattacttatggagatgtggcatttattactattattacttactatttgacccacattcatagttctgtagtttgtactagagcatgcaaaaacacagtgataccttctgaaaataccttggggaagacatagtgcctgtattcacacttgcatttaatgatataaaattgtatcatttatataattatataaaagtcatgggatacaaaaattgcgtttgttgatagtatattctcaaatattgtggagtagtttttacttctgttagagtagttggggagaggtggggataatgtgatttggttgccctgggatgggatcatattaataataaccagctattttataactgggtctacttggtgtctgcctcaaaaccaaaaaaagataagggaaggaggaagggaggaagaaaggaaaagaggaagggaggggagtaagagaaagagagagaaagaggagaaaataggaaattgaatatcttttataatgagcgatggccctttgagcattttctgtatgtagcagggtgtgtgacaggaaaagcagactaaagggaaaattttgtcatttattttaattgggtaagtacagaagaaaattaacttgtaaattttttcacttttaaatatatgtattttcaatccctgcaggagaaccagagtatcagtttttaaatttaatccaagacattccaaatattgtatacagttgcttatactgatggaaaaaagaaaatgtactaagagctctattttataggcatgcttgctttgtttataagactgaaaatcaagttatagttttctatgtagagacttaaaaaaacccacacgactctgattatttaaaaagaccatttaggaggtaacttataaaggccacttacctttaaagatacagctcttaatatattttagtcattctttcctttatttaattactagtaatatttgttagaattcttatgctaatacctcttcaggttgccattacttagaaaggattaacagcttggtagtgactgtcttccttcagtccgattccgtagcacctctgaatgcagtggctgtctatgaagatagcagcacactctgaataagagggtgacgtggatttgtggttctctgttccctcccccaaacagaaaagctacttttttattagaatgaattatttcctcttgagttaaattatgctcaactaatattgtgactagaattgttgacccccctctctgcataaggaggtgtcttttttgacaataggggcgtttccaaagaagaggtcctcactcaagagcgtctccagcatcctcttgtgtccagcatgtggcttctatactgggatggtatcttaggagagtttatgttcttggactacatactagaaggtacgttatgcagacagtgaaaagacaggattgaattattagaatatactttacagggagaaatgtgtgaaccatgttaaataccttgcatgaagcatgtgcaaatatatgaatatgagattatgcttattttggtaaaaagtacgctattgaaaagtaaactaattgtttattttcagtctacctaatgttctttttaaagagtaacatctattctaatactttttatcagagaatttggaatttgtcaacacgtaggtagaaaaaaattggcaagtgactggttcttttaaatagctcttaagaaaattggcacagagcttgccatttgaaataattatgaaaaccaggggaagccagctgtaacttttatttctttcagaatttataataacttccagctaaagaaagctatcactcctatagttcttgaagaataaatctatgactttttttctcttaggagcaaaaaaacaaaacaaaacaaaaaaacgaagaaacaaaagcatcttgggcagtgttattacatttttctctatttataagcaaaaatgaaatgaatatttaaaactttaaaattttttcacttaaattttgtgtaatgatgagaatagttgtgtaggttaaaatactgcaaataataaaaacgaatctagtaatctaaatacatattatagatatgtgatgaactataatattgcaaagaaatgaaaactgcagtatacacagccatattttgtctcttgattgtcacaaaaataaggcactcttaaaaggatatggctgaattttatgatggtatcagtaatagtgagaacaagttgacacaatgaaaataactgaaatgttattcctcatcttttagctaatacttccagaaaattccaaaataattagaaaagctcttgaaaataatgagacctactaggagaaagaaagtacatttgttgccttacagaactattaatgaatttaatagttcagaaagggttcagaaaggggtgaaagctgaagagaacctctgccaggatgttatccctcaaatttaaatagaacaggcattttctatctataatatgtttataagttgatatttctgctttaaatttcaacttgtttttcttctatggagctactaacatatttaacatttaaaataaattttaatttaaacaaaaattaaagttgttacttgtatgtaaggtatacctgtcaaaccagaaatgagtccttacttttagaataatttttatgcttccttatattttttctttccaaatatgagtagaataccctatcatgttttttgtgattacaaaattaagtaaagcaaattagtcctcaattgttactttgtcctagaatatacaatctctgaatgaaaagactctggcactacaattttttaataaacaatattgatatgttaagctgatttgccagtaagatttttttcttcgatttttactaatttaaaaaattacacatgtgacagggactttgagtcaacactttactaaagataaagtactttaaaaatttaaagttttttatcctgtgttttggttgtgatataattttctatattgttttaattagtatgatagtagatgctacagaatttgcttagtgtggtaacttaaaccaaagaaaaaagatgtaattttaaatattaaatttattttaaaaattcttcccgtaaaaatttgaagcgcagtaccttttagttaaaagtgcagtctcaaacagaaaagacctaattttatatattttgagattcaaatattgatttactaaagatgcatataaagaaaccttaataatttaaattatctacacttgggcttttatcttttatatgtttcaggggacttcagatctttctttatactggtaatatgatttagaacccataaataaagaattaaaaaatattagtaatcaaaacatacactaactgaagtctgtttaaaggcagcctgaaaaagaaattagatgatccgataattctggtgttctaaaaattataaaaataccttaatttaatgaatattacagtttatgtaatttagatactgggagaatatcatgaatatacaatatgtaaaatccatacagataacaaaaaagttactacaaatgtgaaagatgaatgatacatctttagtcatacagtgtgcatgaatgcatttgcaaaacaagtgtcaggttttaagatacatcaattcttggttttctggtttaaggtaatttcaataaaactaatacagtcttgcatttcattcaagtatgatgttaggaacttcggtcaaccatcagtatagccatgaccgaagtccattttctcattctgaaagttttctataaaatctgagccttcaaatctagttctagttcagctccactatgcagttgtttgatgtcttgtgacaaatgagagatctgaaggagaggactgagtgcttgttctatgagatgccatcagttaattcttctcacattatctgatgaaagtagcttttagacactgtattgtacttcagatgggaatcttaacatatcaagtttggtaaattttatattgagctatcagcaaaggacaatgtgagttactgaaacaaatcatgaatgtatcacgtatttcatgtaaatgtgatgtaagacgtgtggattggttgtgtaattaccacttcaactttaaaaagcctctataattcacttttaaaattttaaatgttgaggaaagtgaagtataaatagttcatactcttggaaaaatgttactaatgtaagcctcgtagggattattttttattatttttatcttttgaaaaacaatgataccttctaatgtaatttttatcacttaattttaagtctggaacataatcacttgatttaggagtagatataaattattaatgcacattatgctttttttctttttttttttccttaaaagaaagatctcaaaggctttcaggatgaggttctggttcttttactattaagaataattggtataaatggctaattttggtgggagagtgttacatagtctttaggccctcgttattacttttaaaagaatagcccatcggggataggaagctttgtggataagctgccactctttgatgaaggattatacattctcccctaaatctgtgatcccagaatctgttacacaatagttttatcaagtagcactagactagctggctatcatttcatttttctttaaaaagttaattggtttctttcctaaatctaatatttatatggaattttagtctaaatatatgttaggtattaatagattccgtgaaatgcagaggttactattttgatgcaagataatgaagccagattatctattgaagaatgcttttccatttatgccagatgaccagggcattgattcttgcggggtactcagtcatttaagtggggtacctcctcagtacagtctgcaaagtccatggcctgatgcaagttctctgtaagcttttcccctggttaataatattgaaagcaacttgagaagaaaatagtgacatataaaaatgaagccatcatatatatgagggttagttaattttctctgaacgtgtatgtaatacacgtgtatgtaatagtgagcatattatagcttgctttggtcatggattttaaaaaagaaaatgaaaggacattatattatgtgagtatattcccaacttgtaatgaacaattgtttgcacagcataagagtctgataaaaatgtgtcattctaaggagacctctgtttttttggtccaataaatacattgaaaattgaaaattaagtggtcagattacataattgtgtttatatcagttctcatttagtcagcgtcaatcaaatacaagacaattggttctattcaaaattggaaaataccaagtattggctaattgagtcattttacttgtaaaacacaagtaatgccacctaaaaaagcataatttattatggggaattaattttccttaataaatgggctcttatttctgaggctacaagcttctaaaagttttaaaagagtagtaaagttcactataaaaattgcaaagtgagggaatacagttaagtttttctacagtataagtaattctggtgtctgtgtacttactcattgaaacatacaatcagcttcaaaagatggctctttataattgtcacatttctgttctgcgtcatcttctcaaatattttatatctataataaagatatatgatactaaaattattttctgttcttcagtatttataataaggaaactatttaaaagattatttttgtgatcaattcactgtgccagttgattattgaaggcttcatcaaggactctagactttcataatctttcataattggtgtaaatgtaatgttaagaaataaataatactgcctagaaatgagccagatgtaaccaaatttcaattattttatgagatttttagaagaataataatttaaataagaccttcaaacattttaggtaaataatatacaaattttgaatttattgctagtaaaacacaaggtttaatacatatcttaaatcattgtctgatcgagaaacattactcatcatttattatttcagattcttggaatatatgtgtttcaatttagagtttagaagtaatacagattaaggattttgaagagcaggttttccttccatctttcatcagctctgtagctgaaccctcacaatccctttctttattattctaagccactatcagattctaatctttgctgtctccacagctgtttgaggattttttttttttttttttttgcaaatgtaattacaagtacatgtgttttgtgcaactcacttcctatgaatgttggtgatagaggaagattaaaggagagcaggactatgttgtgtatagatccatggatgaatctattagttttcgagtcattatgacagtggttatcaggaagaactgcaaatgttaaaacacaacaattttggcttaactaatatgcagaaaaaaagtcactgaaagtttaacaatttctccagaacaagtgcatttttatgaggtacgcgccactgaagcaagtgattgctacacttctgtgaatcgtttttttcttttctttttttgaataatttcgactttcattttagattcaggggtgcacaggcagattagttacatgggcatgttgcatgatgctgaggtttggggtacggatgatctcgtcacccgggcagtgagcatagtatccagcagctaattttgcaaccctccccctctccccgccctagtagtcctcagtgtctattgttatatgcatcatttttctaaagtgatgccataattgaaaatctagacaaaatatgatagttttttttactttaagaaaaccccattaaaatatatatttagagagaaacgtattaaacccttacatttaatttgatgtagcaaatttactgaatctgtaaaaattacaagtcaatataaatacaataaatctctgctctgatttgaatgtatatcttcatttatagtgtgtgctttactgacacagccattttttctccctcaattcactcaaatccagccccacctgttttgtctgtgctcttgtgtccaagtggctgtgtcctgggaaagatgagaagaaataaggcctgatctcagactcacagggagttttcgtttctagttgaggcatgatataaagaggtaactgatagtaattaaagttattaagaaagccaggagaggtaatagaaggattactactttggtcagatcgtatgtaaatagcccatgggtctttgaaatgccagagaactgaaggggggtacccaacctaatggttctagcatccacccttcctgcagcatgcagacgttagcagtgccttgaaactctgagacactgcaaaggtcttgtggccttaactgctaacaaataacaaaggggccctggggctcacaaatgtttcgaaacatagtgaactgagacagtaggaacacttggcttatcctttccccccaacccagtcgaggccggagatacccaacaaagtggggcattggaagccagtgacctgagaagaacaaaagctgaccatttgcctccttccctgtggaataacttggcaaaatgtttgttgcacgcttgcccacaaaaaccccctgtgaaggcagagacccttcttccctgttctcagtagagcctcagctgctgacacagtgcctggccctgaagagtccaacagtaaataattgatgcaggaatgaaatcttccctcactctacatcaatgtcaagtgtcctcactagagaatagctcctctccacaaaaggtttgtggcctctggacttcggtcatcacctaggactgctcaggttctaaaagtctatggttctattgtttgaagatctcctgtgattcatgttaaatagatagtaccaacacagacttgtcagcatttagatgaggacgaaagatgtggctggagactatagatctctggaaaaagacaagactttgaccaggagaggtaagggcgttccaggagagggaaacacaatggacaactgaggcatcaacggtagcaagcccaacttcacgaacaggtaacagcaacaccagcaggtagcacagatcaatgaatttggccagattatttgcatattaaattttcacatctaccaagatatgcgtcctctcatatttcttaaaatatgtagttctctttgtcctttttttccccatttttgaaagaaacattggtacagagaagtatttctttactgttagaaaaacaacagagcaagtttgatgataaacaatgttgacatagcctcagagtcagagacacatggggagtggtgaggactgtgaactaaagggcacacgctttctccaaaaggaggtgccacgtcgcgcctctagactagtcattgccatgtgagggtgaaacctagtgttgccagattgtgagatttctcaagaaatgccagaagatggattgtgtgaaatctctagattttcaaatgtgagctcattggggtaataaaaaacacacaacatacaaaactcacaaatcaaacaaaacaagtctgcagcctgggtttggcagttgggctaccagtttgcaacctgtgatgtagctgcggagatctgcatggatttgggagactgtgaatgagcagtaggtctccagcagaggctgcctcatggagaaatccaggaagggctggagagagagcttgggtccagattgtgggtaatcttgaatgccatcctcttctacccattttggaggagaaaatgttttcagtttacagtacacttcttcctgctttaaagcagaaacctaggctgccggcaggtcttctgtacagaattactcatggcagggagggaacgggttaagaggcagtagcacttaggcctatcctttgtccttgcccatccctgtctgcttatctctccatctctgcctcccagagtcaatacaaggctcttgacccccttaatacacctattgtttggagcggaactgcagtggccagctataactaaagtatattgggatgtttttgctagcatttgaatgttgcctgaataccgatactaaattctctaagaaaggagagtctaatgttaaatgtgatacattggaataagtcttaaccattatgttaaaataataaaaagatcaataaaattcccctagcacactggttttcattactttgtggtgaccaagttgggctccgaaattagagaagccctcaaatcccattctatcacttacgtgctgtgtgatctagggcaaagctgcctcgtctctgacccttatttcttcatctgaacatggggtttgtaacgatggctggtggtgttgctgttgccaggtgcctggcccggggcccccacacagcagacatggtggagatggggatggcagcagtgtcttcagttgtcggagtcattgtcatcggcaccttataatgaacgtcatgcttaccattatggttttgtggagggtgttggaattgaatttggagactgaagttgaagtccatctgtaccatgaagttgctttggaaaccatgaaattgagatgttaaacataccctcttgtggggtggctgtgaagatgaaatgagctaacacacagggaggtcctagtggagccaggtgtgcagtgagcaatggatagtgtgtatgagtgtgtgtgtgtgtgtgtgtgtgtgtgtgtgtgtgtgtatcaggatggtgccacatgctttccagccgtcagaatgctgggaacaggagctctcatttagggaagaatgaccacaacgcagtcacacagctcctgcgctgtatttggcctgtcacctagaatcttacttttaattaatgaataattcttagcagcatggatccctggcttgccaagttacccattagaagcgctcagctcaaggggaacgggagctgagaggctgttccagtccggcccgtggatggccggagaagtgacagtgtgtgatgtcttatccgggagcagcgacacgatagcattagcgtagtggacgctcatactgacggtccacagttgcttcagagggcaatgtgtgtgatgcatgttccaaaatttatatgaaaaagacggaaagatttttgacatttcgagagagagaaaatttacttagacacatctcctagtgatgccagataacagggatgctttgtgggaaaaacaaatctacctatacagggacagcattctaagtatattccggttcttttttttgagacggagtctcgctctgtcgcccaggctggagtgcagcggtgcgatctcggctcactgcaagctccgcttcccgggttcacgccattctcctgcctcagcctcccgagtagctgggactacaggcgcccgccaccacgcctggctaattttatgtatttttagtagagacggggtttcaccgtgttagccaggatggtctcgatctcctgacctcgtgatccgcccgcctcggcctcccaaagtgctgggattacaggcgtgagccaccgcgcccgcctattccggttctttttttaaaaaaatgaaaataaatggttacctttttccacattacggttagaatgacctaacgagaatattctatttaaagatttagagattccagaaaaatgtctatggaaatgttgtgcccaaattttacaatgtaaatttaccatgtattgatttattgagtagaaaaaattacaagacaaacttgaatatggtaaaattatttctgttccattcacagaattacttagcatttgaatctatcttgtttgtttcttttaaaaatgtatcatgcagagagaccaataccgtaggatctcgctcacatgtgaaatctaaaaaagtcgaaatcatggaagagtagaatggtggttaccagaggctgggatgggacatggggaaggggagacgttggtcaaagggtacagtttcatttagatgtgggaatgagctctggtgacctattgcacagcaaggtgactgtaataataagctattgtatatttcaaaagagctataagagaggagtttaaatgttctcaccacaaagaaatgataaatatttgaagtgagggaaatgctaactagcctgatacatccttccgtaatgtatacatgtggattgagaaattacattgtaccccatagatatatacacttgtcaattaaaaatataatctaaaaatattaaaaatatatgatgcaggccaggcgtggtggctcgtctgtaatcccagcattttgggaggctgaggtgggtggatcacttggggtcaggagttggagaccagcctggccaacgtggtgaaaccccgtctctagtaaaaatacaaaaattagcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcgaagcttgcagtgagccgagatcgcgccactgcactccagcctgggcgacagagcgagactccgtctcaaaaaaaaaaaaaaaaaaaaaattagctgggcgtggtggcgcacacctgtaatcccaactactcgggatgctgaggcacaagaattgcttgaacctgggaggtggaggttgcaatgagccgagatcacgccactgcactccagcctgggcaacagagttgaggctcagtccaaatatatatatacatatatatatatgtatatatatatacaaatatatatatgtatatatatatatacacacacacaaatatatatatgtatatatatacacaaatatatatgtatatatatacatatatatgtgtatatatatatacacaaatatatgtgtatatatatacatatatatgtgtatatatatatacacaaatatatgtatatatatacacatatatatgtatatatatacacatatatatgtgtatatatacacaaatatatatgtgtatatatgtgtatatatatacacacatatatgtgtatatatacacacacatgtatgtgtatatatatacacatatatatatttgtgtgtgtgtgtgtatatatatatatatatatatatatatatatatatatgatgcaaacatacatccactaatgtattagtcggttcaatggatttctttcttttttaaaacaaacaaacaaaatcaatgtcttgctatgttgtgcaggctgtcctcaaactcatgggctcaagcagtcctcctgcctcagtctcttgagttgctgggattacaggcaagctaccacacctggcgaatttcttaatattttgctgaaagcaaattttaaacatttgtctttgaaatgttagttggctccagtgaaaataagtcctttttgtttttcagctctaatgtgttcagttatcatttattaaacacctattttgagcccaacattggcttaggctctgtgaagaaaggggtacaaaaatagaagaagacatctattttagaagctccaaagaaatgtgtaataattagacaaactaacactgtgagctaggattaagtctgaagatgtggaatacaaactgtgcactcggaactcaaggaagagagaggaatgtatagggtggggtttgttccagtgccatctcaacctcatcatttccaagttggtattctgaacactctcttagcctgttcatgctgctgtaacaagacacctgagactagacagtttatagacaatagaaatttatttttcagtttggaggctgggaagtccaagatcaaggtgctggcagactcagtgttccagcaccttgctctgcttctgagatgttgcctcaaatactgcatcctccagaggagacaagctctgtgtcctcatgttgcacaaaggatggaagtgcaaaaagggcttagctagtccctcctgctcttttatgacactaattccatccatgagagcagagccttcgcggcctaattcccgtcgaaaggcccctcttcatactgttgcactggagattaactttcaatatgaacttcggagggacacaaataatcaaagcatagcagtcactcttctctcaggcctgaggagcaaagctgccccttctcctgtatttgtacattatcccattatcctgtttgttcacacatgctggaagcttaagagccatcttcaagacggctccatccctcactacctgtactaatcagtcattacgtcctgctcattcttatttcagagtttctggtccttgcccctcctttccatcctcactggcagtttcctctctagggctctcatccctcatcttaattgcacagaatgtcttctaactgggcctcctgccacccgtctttcgtctctccaatccatttttctagattgcccctggagagtttgcctcctaaaatcctgaaccgatcttgtcacgaagaagcccaaactcagcatggaagccgagatccatacctcctgatctggccaggccccttccagccccgcctcccatctcttaggtacagtgtgcctcacacaaggggatttagttagcatttccaagcacgaggcgagtcttcccactttctgtgtcaggttaaacattctctgtgaaattgtccttgatttgctcagtagaattaggtactcatctccctctctctttctgcccccatgctgctatagtgtttctacatctatttagcatttacctcatgctgcacttttagtttattagaattcaagggttctaggagtaggaaggaatttagagatcatacaggcagagcctcttattgtaaatgtggcacaactgaggataaacgtgtagccctcccagagtctacttttcagttgtccttgagtttgatctcagcatcattgcccaagaagagcttgatttcctttgctctgtgacatctcagcaactgcctctctactttcttggtatctgtcctcttctagttggtctgcaaatactagggttcctcagaaacaagcccttagaccctctgccttcacactgtatccactgtcccagctcttgcaatgtcatagattcccatggcttcagtgttcactcataaacaggcagttcacaaatattccactcaaaacttctagctccagatatgagtatccagggggaccttctaacctatcatccaaacagggaccctgtgagagtgacagtgagcaccaaatcaccaaatgacaggatgccaggacaactagcattaactggagcatccagagccagcaggcaccttcggtcatcctggtatactgaaccatttcacgtatgctcttgcatgtctcaggctcccaaaactaacatggatctgaatccataatcttttcctgcaaacctcatctttcctgggtggcccacattcagtacaggaaaggaactgtccatcaagttaccaagccagcaaccttgaactggtccttggtcctttcttcacctcaatcccactcatcacattgtctagttaatattgctttctaagtatctcaaaatcatcatgcttccatttgtcttccacccctgccattctagtccaagctcccttggcatctggactggatttgcacggtgacttccatgttgacttaattgacattctgtggagctcctcctccaactcattctccacacctcaaattgatcttttaagaacgcaaagaggatcctgtcatcccttgcttaaaacagtgcataaaacataatacataatggaagacatgatatgtgtctttcttttccacttgattgtcatgcccctaaaaccagggaccttgtttgttttgctcccttttgtttaactggttgcgtgacatagcacctcatacatagtcctggatgaatatttattggttgaatgagcaaatgaaaaaaagtcccagggttctaaaaacctacttcagaccgctagttccagagtctctgggttcttttttccctcaaggattttaacctccttgaaggtagaagttctgctgttctatcattgaatatttcattctttcccattttggaaatgagatactcctctctactctttgtgtcttcagtacttttaaccatagctacatcttagaatcaccagggagcttgcagagaacactaatgccaggattttgccccaaactaattaattcagaatctctagacataggaaataagttttaaaagcctccctagtgtttgtaaggcacagtcagggttgagaagccactggtttaaatctggtcatccttcaagtcccttctcaggcatcatctactccagggaaactcagatccctcatttctcctcaggacttactagtaggtagtgaagtgattctatgatcaatacttatttcattattttcggagttccattccagctatgttgtaaggatgcattagggctgagattatgcattatatttaggaatttgctgaggaccaaaaagttactttataatttccttttatttgacccatgttcacttctcactttggaaagacttcaggttgataagcaagctgacttctgatttgtggctgcctctatggtttaacatcctagcaaatttttcttacacgttccgtcgtgttcctgagctgctagagagctatctgagtcagcggttaactgaggcttaggcacacatagtcatcagctgggaggaacaggctaaacagatatctccttgcactacttagaaaaccaactttccatcaggaactctgggacttttagaaaatatgtatacagcttccatgggtcccttaagttattctgttattgcagcatgcagcacattgggtggaaacctaaaatgcacactgagtgactcccctttcactcttttttggggggtgaagcagggcaggtgtaaaagcagttttttgtttttttgagagagtctcgctctgtcatccaggctggagtgcagtggcgtgctctcggctcactacaacctccatctcccaggttcaagcgattctcctgcctcagcttctcgacgagtagctgggattacaggcgtgtgccaccacgccagtctaattttttgtctttttagtagagacggggtttcaccgcattagccaggatggtctcgatctcctgacctcatgatctgcccgcctcggcctcccaaagtgctgggattacaggcgtgagccaccgcacccggcctgtaaaagcagttttttaaaatgtgcgtttatgtatgttgacccaggttactccgttgtcccgttggtaaagactaccaaatttaatgtggctgtttcgtaaagataccttctcagagacatcgtcaaagagcatgctttaaaactctgttcaggcacatttgcagctttccataggaaactataaaggcagataatgtcatagcacctttttctaaagccattcttagggacttcagcattgacgatatgattgagggaagagcagggaggaaaacagtgtgtctggagggccccctgggcttctgccatgagattgaagcttggcacctcagtcatggccattctgcacaggtaaatcttaaaatttcatcttgaatttttcatggcatcatcaactggtgtagatttgggtatcattttgcagctgccaagcggatctttgtgtcagttcaccccaaactacatcacatttagcaaaattgcccatagtatgcaggtaatattttgagtagttttatgatagattttgacatttatttcttttcttctcttttcttttctttttcttttgtgacagagtcttgctctgttgcccaggctagagtgcagtggtgcgatctgagctcactgcaacctctgcctcccaggttaaagcgatgctcctgcctcagcctcccgagtagctggaattacaagcaagattttgacagtatttctaatcaaattcctgctgcctttataaaaaatccacatgtttactcttgtgaaattatttgttataattgttaaactcttgggttttttttttaaagacttagaatatcataaaggtataaagagaagaagcaagttatgtttagaattttagctaagttgttttgtggatgacattctgtgttgggtttaaaatgagattattgaagtgggctacctataagatagagttaatctaatgtgggttttggtgtgctctatggttaactgtgggtctcaaaaagttaagtgtacttcaagtgcagtatttatgtaaaaccactaagataagatcttgctgtgtaatctttgctggtgctcaagctaactgattacaatggctggcattttcactgttctcacacttacaaaaataaaatcagaaagcttgagaggatagggaaagacatctggtgtacaaaatgaagacatttatcaaaagggatgccttttttccttttaaaaactgcaaaaggtttgtttcatctcattaggcttagaagtataaattttacataattagtagaaagttgaatgaataacagaaagttggaataaatatttgctcttgtattaaatacatatgaaatgccttgctttagtatattgattatgctaatttatagtctaaatgtacaattagattcaggaggcataacaggatgtagaatttgataaagaatacattaaagaaaaagaattcttgtgtagacctgagtcttaaaaaaattaaaaaataacatttaaattttcttgtaggcctggtgtggtggctcacacctataatctcagcactttgggaggcctaggctggtggattgctagagcccagaaatttgagaccagcctgggcaacatggtgaaaccccgtctctacaaaatacaaaaaaaacattagccgggtgcaggggtgcatgcctgtagtcccagctacttgggaggctgaggagtctgaggtgggagaatcacttgagcccaggaggtggaggtgcagtgagctgagatcatgccactgtgctccagcctgggtgacggagtcagaccttgtcttaaataaataaataaataagtaaattcccttgtagaactataattgttttatgatacagaatattaatcactgcattaaatttggatattattataacgatatttagtaaaaaggacaaacttgaatttctgttcatcccgtcacacctctcgattagagctaggtgagttacatgtagttataaactaaagggactagaccccaaagctatgttcactctactcttcacttttaatcacatatatattttcttttcttttttttttttcgagacagggtctcactgcaacacccaggccggagtgcagtggtgcaatcacgggtcacagcagcttccatctctggggctcaaacaattctcccacctcagcctcccgagtagctgggactacaggcatgtgctaccacgcctggataatttttctattttttatagggactgggtctcactatgttgcccaggctgatctcaaacacctgggctcaagcaatcctcttgccttggcctccaaaagtgttgggattacaggcatgagccaccgtgcccagcccacatatgtattttcttctctctgggaaactagccttcgttttctccaattattgacttatttctttttcacccaggctttgtgttaagctcctggatctctatgaaaccgctgctgatacttctattagcttctgttaaaagaaatgaaaaacttcaccttacaggtttctttcagcatctctaaaagtctctgttgttaatatagtattgagacttatccccaccatagtcatttgcataaaattattatactgtatataaaagtttaagatgtaactttaaatgaacatgaattataggtatggataattgcattaattttggaaatttgtgttgaattttcttctctaagtggatatctcttagtgctgctcaacagttagcccattttatctcttcatttatgttggccatttttcatttatatcttctgaaaaaaattcatgtatatgttctgaaaaaataacacactgtatacaattaattgtatttgcccaattttttagaatatttgtttatatgtatacttacaggcttaaaaaaatcattcacatggtccaaagtgactgatgtttaaaagtgacagctatatgagggaaaacgtatatggacagatatatgtcatataatcatgccatacacacacacacacacacacacacacacacgtgggtgtgaatgaatgccatcttctaagatctgtacatttgaccactattaatctgtggttcttgaaaattaatgagattaattcataaaccaagtgatttttgaagcctgcagtctggcgagtcaggttggttctgttcctttagatagcttaactgagtacaaaatttggggtatagcatttcagaagatcctgctgtttctaccattagttttgaatgtttattgtaaagatacttttcaactctaatgggagagacagcaggattctcccaaaaattcaagtaaaaatctgcacgaggaaaagaagtctcctgagatggattgaattcttctgaagagaaaaatatataatttactaccacctaaaatatgaatgaagatatatgtgaggagctttttagaggagaatttatcttatatttattatcagaaagtgctgtgaatttaaaatctttcttttgcccaagtcaaacagaatttccagtaataatgagaaacgtgtgactcttgaccattttgtttaccaaataatgtagtgtgagatatctctactacagtaataacttccggtgtaatttacattggcgtttgttaacagcaaaagacctctcctgtgggggttaagaatatttaatcctttaaagctgacatatataacatgtagctatgtcagctacagctgtttctaaacatcagtaacaaaattatagacaggttttgaagcttctgtggtgggaatgaatacatctgaggattcaacttgctgacagtgtttttgtaatttaatcttaccatctggtagaaagtaaacattttttataaaattaaagtttataaagtgaatcgcttatagtttccgattgttgtgaatgacaaatttaagtgtactttcattgaagaatgaatggagattctgccactgttttgagatgcatactagatcgcaactgattttgccatttgatcttcattggttccttgaacagtaaacaaattggcactttcatgtcagctaaggattctgtgtttcatatgtctttcattcctttaagatagcatacatgttgttacttgttttgcacagaagaaactagggcttggcaatttgtatgtcggtaatgtcagataagtgatgtcacaaatagaatgtacctctgaactgaaaataaatgattttttcattgcatttcatactttcttctataacgtagttatatttgtataatatgcatttagctattgtctaaactattatggtgtaatccagtgtatttgctttgcaagtagcacctttctttctccttagaagttggcaaattagcagatttgtgaaattgacaaattggtttacaaaccctgccaaattcaaactttataaatctgatctacgccttttacttgaaataaatatacacgctgatagactcttgtgtttatagttgtgccctgtgttaaattgaaagcctacactctatgatgatgtaataaaatttaattagttgtaagtcaggttttggttaatggtaattagtttagtgtataattattacatctaatagcaatctgaagtctgcaagcattttgatctttttccaagtaaaaagaaaaaaaaccacaaagctcctgtaagatttatagcagaaattgcaataataaaatcacattagctaatttcattagataaatcacagaaaatgttaagtggcaaagtaaaatttcagtgatgatgtacatgtgttatgttgagctggtacataaaatatttttaagtgagttttttttcttttcaattaaaactatctaatgcgacttttgatgcttcttactatttaaaatacatcatcggtagttttgcatggcaaaattaaatgttattcccataacagctattgtagagtgatcatcagggtcaatacatgctttaaaaatcaaagaaattttattaataaatttgaaaaatacctttaattcactgagttctgacccataaaatttttacaggaagtattgcctgcttccaacagaataaaaagtagctttcagctaacaaggcagtaacacaaaaatatattaataccacgtaagtaaatgtacatgagcttttaaattagtatgtttaataaattaaaaagcataatgtctccctgagttactagatactgttatatttaattagtctatgagcccaagattaaatcagggagctagtcatattatacttttggcattttcctacttctcctttcaatccctttccctaatagaaacctctttctgtttttttcttgtatgagccgagtgttgtctcatttctgtttttaaaaatgtgtttagcagcctttctattttccacaaatttattgttttggtttttagacagggtctcactctgttgcccaggctggaatgcagtggcacaatcatagctctctgtaacctggaactcctgggctcaagcaatcctcctaccgcagtctctcagtctcttgggtagttatttttaacttaaaatttataacccagatagattggttgtaatgcacaacatagttcagtgccaagtatgttttccacaccaaagactatggttctcatcattcgagtgcttgattttagaacattcagataaaaaacaaaagtttaataaatagtgtgttgtaaaagtcttactaaaagtggctaagttgatatcacaagactattaaatagtttaaaatgaattttcatggcttaataactgatttttataaaccgtgcttaggtttactacgaatatatagaaaatatttaaattttctgtatctttgattttttttttcttctttattgtaccttattaggaaagggtctgttttgacttcaaaagaggtcttatgttatgatcattttcatttggcaaggagaaagaagtgatttgatataaaatattcatgagctgacataattaaaaatattaaccgagacatctaaattggcttttgtagtacaccattataaatatttagctctctgtgaaatgtctgtcgtgttgtacatgggttttccataggatatcatttcagtttttataaatttgaatttgtatttactaacacatgttaatctggcattaacactggatgtgtatttaagaagggtatactgcagacctagtaagtgcacagtcaggactgtgtggggagggaaagactgcaaacagttgtcagtcttcaaagtgagataagacacgtccattaaagtttgcaatacaaaacagtatctaattcggtaccaaaggagatatttcatgaaagatgaagttggtttgctgctttaggctctttctgagtagctaccatgtatcctttgtttagtactcaaccttagaaatttgacttcattcgttccctggctgtgataagattttgtgaaccaaatgcacaagatactatttaagaaatcagtcttctaaattgtgttggagaataaccctatactcaaaatgtttttattgattattttggccactggcaatcaaggcatctgaaaaaccgagaaactataatcataaagttactggctgaatttaaaattatttattcatactttcagaaagttaccaatcgagtcctactatatgcaaagaccatgttaaaaataatgagaaacagaatatcttggtggatatgtttctgccacccagaaacatttaccagggtggtaaagatcttgtattaaaatatacagagtttagtttcaaagtaatagtagtgaatatcttggtgaatccttactgcaatattaggaaatggatatgcccaatgcagagtaaatttaacagttctttcttacataccaacatgaataaacatgagcagttgacttgactttgtgaccacatgaatatggctacgtgaatggacaggaagaatcccatgaagattactagattttatcctggattctgagaataaatgttaaaaacaaaaagctatttattcccaatctcactgtcttaatgaacttttatgtttctgtcaaatgggagtggagaatgacaagtaatcttaaaatatttatggagtcaacaaatgtttatgatgtgccacacacataagggttcagcacctaagaggcagcacttggacacctacagctcggaagtgatcaagacagaccttggctcccaccttcatgcatctaagatgacaatgcaatgtcagagtgaacattcagtaggacttgaagatttgtgacaagagttcagggaaaacacatcagaatttttggtgatgtgcatttagtaggaagttgtggttaaaccttgagaataaatttgtccctggaaagagataaaagaacaaggacttaaggactaaaatttgagtaaagctttcaattaggaaccaataaaaagatgaggaatgggagtggaagccatggttatggagtttggaaaagtatcaaggtcaggtgcacggatataatcctatgtggccaggaagtttcaaaataggaagaccgacagcctataccgaaggctgtgaagaatgaagtttggaggagagcctttatacttgattaggaggaaatgggtatcatctgcccgtgaacttgacactggggttggaaatgagtcctgagatatgggaaatagagaaaaatcacatatacagcttgttacgtaaatccagcagcgaaaggaaggtgacaacttcacacatggagtatctccaggaggtttaaagataatgtggataaatgttgagaccaatttttcttgtatgtaagttctctatagctatgtctggagtatggatgatttttatgtaatatattataaatcttgacttttggattgcttctttggtggtacaaaatagaaaaaaatgctattttgtattaatatgctttagtcactttcttgtaagccataaaacatttaaaaagcagactttatgcaaattgataactaaaaaattgttttacacagaaattaagattaatttacttaaacactgtgctctacatttatctttatcttgatgtttatcttgatgaccaaattatgtcatcgcgggaaatttctctttatccattaactaaatacatttggatactaagggtagtgtctctaagagtaagaattatttcttaaattaatatattcatgaaaattcaaacaaacatagatcatctattagaaatgtaatttatatacagcattaactcggaactgattctttgtttttcctcattcttctgggattcttgaaacacaaatctaaatgtatgtggctgcaaaaaaaaaaaaaaagctctggatagctgcctacttttgtaggcactctttttgtgtttttttttttctcttcttctgatttcatctaaggaaagcttccttagctactaattcacacacacacacacacacacacacacacaaacacacactttaacagggaggttatgccccttaagctcacctgaatgacccacaatattggaaacagttaaatacttggggtcagatagagccccaccagggaggtggaggcagttgaatgcgtattagaaaatcaagaaaataattgaaactggagaactctagtccattaatctggagattccttgtataaccaatgagctttaatatccaatttaatgaaagatgcttatttcactttccagagcagaaaaattaattggtagctataatttaagtttggtctcctttctaattgaaagaatgtctaaagggaagggaaaaacatttttatttcactcattttcattttttaattccttttttaaagaaaagttttattacaagtattgatattttcattatttcaactgaaatatttgttacatattatctctaggaaaaaaaatcctttaaaggctgcaaacagtgtaatgaacttgcaatctgttctctgggtttgcaggtgtgaggattaaatacgtccaggcacataacaacatttcagaaaatgcattttgaggctgataacatgatcataatatattttgtcttttcactgtgtcagaaattaattttcttagtggctccttgcaacctatgatttttttaaagagatttttattggcagctggccaagccttgatgttctgttgaatgagtgatactgaacacttgagatgagtctcctttttacctttgttacctcaggcctctgctctgcttcattaaaaaaaaaaaaatatatatatatatatatatacacacaagtatttgcaaaccataaaaagtctatatgctagtgaatgcacagagatgttttgcaagctgttttttcagtggtattcttttcatttatccactgcgtaattctaaaggtaagattcctcagggtgcttgtacagaagtgctaccagaatgaaggggcagacccataggagcgtggcctacttaaaacatctgaaaataactaagaggcgaccctcctgctttttcccctgccaaggagataccgacagcacaggacaggttttgactgtcttattgtcagtttcttcccctggtataaggccagatgatgctggaatgatgtgtctattgaagttgattgccactgtaaggcttagccaagtttgtcttcatgagggcagtgtaggaagaaccagtgtaattggtttgctgaacccctaaatttgaaaagtagcttggttaaccatctccatagaaagccaacacgcttttgcatgtcgtgtgcacgtgggtgcatgcggaacactgggatgatggctcagtggctctgagagtagaggcttttcgatacaattggaatgacacccccgccccccaccctgccgccgctgcacattgcagtacggtagctccggccatttagtgttgcaggtggatgactcatttgatcaacattaactatgccttgaacaatattttcgttagtaatgtttttagttatcgtttatagtttagttaatgatttcgttagtgagttaggtcttgtggacaggataaataccattctttaaggtcacatactgttagacttgtatcacacagaaaagacacaatgagtgtagggcctcgtctatagaaggcgtgtaataaatgatgttcagagaatgaatgaatatataaatggcacatttgaggggcggagtagcatactggttaagagcgtgggcttcaaaatgaactagcagtgtttgaattacagcttcaccaccgtgtgtcttttggcagattacctcctctgtgtgattcagtgtcactgtgtttaaaaaggagatgataatgttgcttacctcatagatttgtaatgaggcttacagagtttacatatgtaaacatgttgaaatcgtacctggtacataacactcaagatgtgttcattattattactgttattatagaaattgaaacatagaatattttttggtttgaaaatgaatattctttcagaatgacaaattttaaaataaactcgtaattatttgttaaaacagtcaccaacatttacataatgttttagttagcagaactctttttacatataaatttttaaaatttggtatacttttttttctttttttgtttttttgagacggagtctcactctgtcacccaggctagagtgcagtggcgtgatctcggctcactgcaacctcctaggttcaagcgattctccagccttagcctcctgagtagctgggactactaaattagcatccggctaattttttttttttttttttttttttttgatttttagtagagatgaggtttcaccatgttggccaggctggtctcgaattcctgacctcaggtgatctgcctgccttggcctcccaaaatgctggaattacaggcatgagccacctgtacccagtcagtgtactgttttattcatgacctaggagatggacaggacagacattcaaattttagagatgatagtggaagctactttgaggaaaaggtgacccatgaaaatcaattatgaatgagatgagcctgtaagcacccacatggggacccgcacggagcagaagccgctgtgctctggtgctcaggtggtgcttaataacggcttcttgttcccctttgtcttgcacgaggtgttaccatctgcattgccagattcagacaccaagacccaatgatacatttcattatttttaatgtgtgatcaccccacaattgcgccagatgaagtagccccaaacactttcactttctcaatctaaaaaatatcttacacattcttctgcccggctgcattggagttcctgcttagcatcagtacacagagccactcagaggagcatgtccccgggccctggctctacccgctgcccttggtcttcagccagcctgatgctcctgattcactgttttggggcatttctgctatggaaccaccctgaaaattatcaaattaggcaattacaaatgatctttgattcattattgaaatgaaaaaaaatttatttaaaatggggacatatttggcatacatatatatatatattttttttttttttgctctaccctcaaaactacttaagtgatgttgcttgttgaaaggtttttttgttttacttatttaaattgtttatttttcatagagacagggtttcaccatgttgtccaggctggtcttgaactcctgggctcaagtgatctgcctaccttatcctcccaaagtactgggattacaaccatgagccactgtgtcctgctcttattgaaagttttgaaattcagatgagacaacatttaaatgattcctgagaagtcaagggatttaatctatgggcaaaagacgaaaagtcataaacttttgtccaatattttatatgttttggtttttgtttttttttttttttttgctttaagagttagctcctgttaaagcactcttccaaagtgttgtatgtatgcaggatgtatgcatcttcctaatagattatcagcaaccccctagcccctgcaggattggtattttgtaattatgtttcatcctacaaaatagagcaccctatttaatacatatcagctattaaatacgtgatcgaattgcccatctataactcaaacttctatgcctttaataacaccaaatgtcttcaggatttgtggtggctgagaacattcagataactaaatggcccactttattcttttagatagatggcgtcaatttctactgcctcaccaaaaaattatgtagcccagggatagaactttcctaataaattttacaaccagttcctgagaggccagtgaaagatcattaccttcacaacactgttgctcttctctgtggcttttgtagtgattcaaacaatgtgacagtagctaacccccatggacaagtttaatagaattaaagaaatatgaacctacaaacacacgtactaacactgcgtagaatctgtgtcttgcatgttcagggattctcttgttttaggtcgtgtaatttctcataatatgtgtattgtttcccttctaaatttaataacagtaattttgttagctgtggaatatttaagctaaatggtttgaaaaaattaagtcaaactccttacataattgtttcttaaaaaaataaaacaactccatcatcattttcctacagtgtgtttgaagcttctaactttctccagacatttaaaatgactctgtattttaccctgggacaatgtaagcattctaaagtgttttctagttaatgtttgtatatcagcttcttaaacaggtgatgcagttatgaaacttcacctgtatacatctgtaaattttctgttccagatatttaaaagcagaagtcaatattggaatgaaggaaatgtaccagagtgtatattttagagtaataagtgaaatctgctgttttcaacgaattccttttttaaattttaattcctaagtatttgctgactgaagaacagtatagtgcctttaaggtgagaatttttgtattaaataactaaaataaaccgtaaaaattgctgagcaaaacatatctaaatcttgtatttaaattagatttcatttcaaaatgcttttaaggaccccttttatttattcccctggtggtctttcaaaagccaggtgtctgggattgtctccagcctgctctaaaagcaccccaggctttggattagtacaagagagcagctgccttttattcagcagtgcccatttacataatgcctgttcatttaaactcacttggaacctatggccaggatgaacccacaccagagtgagtcagcagtgcatggtcttgtttttgcattgaattaattttaaaacatccctctcttccacagctggaatgaaagacagtactgtagaggcatttctcgattcaactgctatatccttaaaggcaatttaagaatcactgttgcatactttatcacaatatataatagaactaaaatttttaaaaagcagtgtatctattattaaacatttcattcttacaaaatagactatggtagtttatagaagagaacaacaaaatgtactgaaaacctcaaagtaatctctgctctgaaactgtcatttccctctcacggaacacatttacttaatcctttgattcaactttcaagttcaaaaagcatttttgtgtgtgtatttgtgaaacaggaagtttttcagtgttgtttttgtcttctaaatattgtttatgtttgaaatataagtcaaatttaatattatggtataagatgcttctttaattttaaacttttatattagtttagaatatgtatgtggcttagtcagaaaaccctcacctttgtcattttttcagacctcatattcagatccatttttgtgttcttctcccaggagattaggtagtctctatgggctttgtactaagggcaggaatccacttccctaagttacagcctgctttatgtacttacttaagtatttgtggggcagaagtctttaatagttggaattgcacatgcactagaaatttaaataaaacctactttcagggtaaaaaaaaaatcgaagagttttttttttttaaatctgaattttgaattagttttcttaacgtgaactttccaaaatgctgctttacaaagtttattttcattcataacattttaatgcttgtttttccttgcttttcaccaaatgacttgaactggaaaatgttgatgtttagttacatatttatggaggacgataatctcacccatgtgtctgcattacttgcctctgtgtttttcccctagttaatatgatgtttatctgctgttacactttagttatctttttgaaatcctgctttgacatctttctttagcataaatttatgcagtgattaaatcttcccatctaccttcatagcatctggtgatgttatatagtaaagagagtagtatttttttaatacttctttaatttagatgagtttcataaagtcattctatatgagtaaatggccaggcttttttaactttaatatattcagttcactatgcatgtagaaatataaattaattttattgtttctctttttttttttttctttttgtagagacagggtctcactatgttgcccaggctggtcttgaactcctgggctcaagtgatcctgccacctgggcctcccaaagtactgggattacaggcataagctatggctcctggcctattgtccttcttgatagtagtcattttttttcagaagtacctgtagtagaaactacattaactttaatttctttcattaaaacaatttcattgctcttcctcttcacaaatcacatcaatttattaatttttattttgttttattttattacataaatatatatacatatttctggctgtcacctgactgaagaagaattcttcacttgatcacagccaaaaggctgagaaatgataagaattcttggtgattttttttttaatttactagagataacctagtttttcttatctacatggacatatgagcctgctttgtggtgttaaaacaaatcaaaacgcagcaaccaactaataaaacagtaagaatgaaacacctttcttaggagtgaccatcaggcattccgtatacataactaatcaggactgtttcatttctccctttgctgttccccctgaaccttgaacctaacaataagaaataatagaaaaccaaagctctgttatggcttactaaactaacacccttaaaaggcatttgactgtgactgagtatgaatgagaacggtccccaaatcttctgctgaaagagggggccctcccgtgggaggctttagttgttttcctctttttaatctgcgggagccgcggagctcagcttcttaacaaaaccagtattagtgaggagatcaaaaccaaacacctaatatgctcagtatttgaccacctttttataaagttaatcaaacctgttaagaaaaatgtaaagtagcagaatgtaatattctggaaggaaattacatcatataatataaaatcctagcagtttgaccctgtggtagatgtttactttaaaatagttaactgattttcagcagagccgagtggtcattctcattgacttacccataatgtgcagaacacctttgcaaattcaagatgactgtttacaatataggtattatatgttgttagattatttatcttcagcattgctttactttcatagtgcatttggtaagtgtcaaattatagtatactgcataatcaatcactgatatttcataaaaaataaatcagttgtaaatgttccactgtttctggctaatgtcctgttttttttttttaatttttgtttttagttttgtttttgaaaaaattcgataggtagtatgtcctttgactttaaaacaggaatgagtgagcacatgcccatatgttcaggatagaaacagttttctgactgatataaggaaattctagcatgcatttttaaaattatctttcttctattggggaattgttgctgatggaaaacactgcagtgtccaactggatggttgtatccacctagatcagcaatgagaaaggataagaaaatttcagacgtgattttaacaaagggcggggtgttttctgggatatatcatttcaagggcagcccgttttttcaagaatctcttctattattctatgatgccaatagaatttcattctgattttgggtgaatgaactaccgcctattaaaatgttaatatctactggtcagttatttctaagcttgaacttaatgttaaataccaaattttgtcatgtatgaagggaagaatggattcagggtgatgaggcacagaaaatatgaaggcaaggatttcttggtatcagcagagggtccaggaggtaagataagggcactaaatggaaaaatggagggtcaccttggaatggttctgatacaggcatagcgtatttctgcaccaggagaatgacttatcaggttatatgcatctcttgatgatctaattattctaaatgacagaagtatgagcctgcctgctaaagcagtgatgtctaaggccatgactttgaacctagacgccctgagttatcagcttagttccactgtttaactgttgtgtgttcttaagcaggtaacttctatgaacctctatctttacccctctaaaatgcctgccttatcaggttgttggaaggatgaagttagagtacacgtgtaaaaagtacctacaaggcacattgttagttattttaaatatcactgatttttataattatccaaatgttgcaaacaaacaagtaatacaatttaaactcagtgtaccaacagtctattatgattagctaaggaagaccctggacaaaccctttttggaacatggaatttgaattaaatacttggttaacttttatggtatacaaaaaataagacaacatgggtaagaagtatatgtttacaggacaaactctttgttctggttaggagaaatatacatcaatttgatgagaatattagatgaaattggaggaacagttaatttatattagcaactgaaaaaatagggagttgcagaaaattaagggtgaaatttggttttcaaagattagaacagcattttattttattttgtttcttcttattattattatttatactcttcccatagctcagggaaagcaatagaactgcatttgagaagaaaccagaattttttgagaaacactgaaggctactttaatcaagccagaacccacctagaagatgttccactgtttaaccagttatttaaaggagtgcttgctttcatgctcaaaggagctggagctgagggcctagttcatttttcttgcttgaggaagggaccttgattatgattcattcgtatgcagttgcggaaccaaggactactttgggagaaataatttctactcccgtgaactcaagggaagtctccaggaatgataaggaatgaattggggaaggataatttcctttccttcttttctagttattccagctgaagtttaacatactgagagaccagataacatatgtccattttttatcagcattttcgtttttactgcgtcctcaaccatgtgcacatttacagaactgtcccaagtagaagcatactaagattgtggaagttatttctgaaaaagcagctaaccttatctagatcatattatattaataccacacgtacttattttacatatttgttttttattcaagtgttctagtttacttggtcttttacattctagtcttcagtggggaataaatagcaaacatatgagtattctcaaatgtctgagtttagtaaagttaaaaatatattctatattaaaactacaagtggccttttctacatttatataaaaaaaccaatagttatatgttttcatcttgatatagaaagtggtaggtctgttttattattccaaaagaagcatttggtaagttttgtaaaaagctgaccagcagtttgattcctcaacttcaaaaagtttaataatattatagcagctggttagaaattacagcaagagtactataggttagacaagcagagatttttgtacaacaaagatttttaagcaggctgtactagaagattattacaaattcattcccagtagatctctaggtttctaagactgaaatttctggaatagaagttaatcaaatccttttattgagtacgcaaataattccactgggcctctggggagttacataggatgtttctttctttaaagagttttcagtttgatatagaagcaagataaaatcttatgaaagcaccaaaaatttccaaaaattgccctttcatcacagatgtaagcacttaataaaacgcatttgatgatgccaaaaataaattacaactatgaagagatgcatggttgagttttttttttttttttttttgagaaaaggagtggatttcttattgctttaatgtgaatttttagtgtctgaaaaaattaaaatgttttaaaatttagccaaaccttttcaagataaacatagccagcctactgctatgatttgtcatataggacccagtattttctgtcttgtgaaggagatacagatggaactacctagctaatcctcacagagaagaaatgagatagtcttgatgagtagaaagattagtcttttttctttcttgagctaaaattattttgttataatcatgtgaaaaacctctattttggccgggcgtggtggctcacacctgtgatccctacactttgggaggccgaggtgtatcacctgaggtcaggagttcaagatcagcttggccaacatgatgacactgcgtctctactagaaatacaaaaaatagctgggcatggtggtgggcgcctgtgatcctagtaactcaggaggctgaggcaggagaattgcttgaacccgggaggtggaggttgcagtgagccgagactgcgctactgcactccagcctggacaacaagagcaaaactctgtcaaaaaaaaaaatctattttattcagacttttggaaggaggacagaagctgtcaaaaaacggattgcaaatgtggcttggggtgtcttccatcagtcttaaaatcatctcatttactttcttttatcgacatagtcatccaagcaatgtaacctattttctcagttctattaactttagtgccatcttcggcttctgatcagcaactgaacaaagttttaagttgaaggcaccatagcataaatagagcgttcttttcaagcacttatcactgtttgaacagaaactgttttacatattctttacaatgatctgttatttagactatattgggaatctgatcaaaggcagtaagtcactctgaatctttggcttttatgaatttaagctcagcatttgagcaaagaactaaaaaagaaaaaaaactttcattcttacctagacaacaaaggccttttagtcattgcaatcttgttagtcttttctgagtagtctcaccagacagagagtgcgtcagttacaattccatcattactctttctaacagcccttcaagcctcctgctcttcaaagtagcacagagcactgtatgtacttggtcccaccattcagagccagaagctgaaacaaaacgatgccagctgactttaaggcaatttccttccctctgtggaaatttctgcttcttctgttgaatcgattcactgagtaaaacttgacctcttgtaatagtgcatacgcttcgcagtgtgccaaagtgattcaaaatgaaacagcggttgtacatagaaaacatggaatgtccagcttagtttgaaaatgaaaatgcctttaaaatctgcttttctgttaagagaactacatttaccaatacattagatttttctgctcattctaagataattaaagtaatggattctagcctgaacgataagtataagcacatagttaggcttcctttatatatatatggaaactgaaatgggaaaattacacaattaattaaaagaaaagaaaaactgtctttgttaaatggtgtttttgacctcaagtattacaatgattgtttcatgtgttcaggttcctatgtgtgtgcacactcatgcaagtgtgtgtgcatgtgtgtgtgtacacaagtccacaggagatgaaacatactcatattaatcttttgtcaataattgttaaaatgtagagaaagtaggttagtaggttgatggggccaagagatgaaaatacttggatgaaactgatatatgatcatgtttaaaatatataaaatatatacatagttttaattattccttttacaaaattcacctgtttcaaccataacttctaatatgtatatatcgatgtctttgaattcagagagaaggaaaatgtgtttatatttttaataatagaagataatttgcttgtttttaataggagaagatcacttactttgctggaacttcttacatttattacatgttatttaccggaaagtaatgttaaaccatgtctatatgcacagaaggagtagatttcacacagccaatgtattgacttctggatcagtactgatcactgcatttgtcttaattaagtgctaattcatgtcagtgagatagatggatttttaaaaacttctgtttatctgagcttagatactttgggtaagaaatatactaatgcatcatatatatatatatatatatatatatatatatatatatatatatatatatatggtcctaccctgttgaataatttgtgttagacacctcatttctccagattttctaaaattcaggcagttggtgtgagggtggaggtaggaggtattggcagagatagcaccgcttcttcagatctctaataaatgtaattagttcagttttatgctttgcctttttttaatagtgaagtgattgtagtgtaaaaagagcagttgtttgactatattatttaattcaacagacttttcttccctattctttaaaaagaaaagcagttattcaaagcataaaaagaaaaaagagattaaaaataatggtctgtaaactttgcaaagtacataagaaaacctcattaattctgggtatttaaagtataaacaaaatctaaaataaatatgagaaaatacaagaacagaaatcttttgaagaaaaacaacattctaaattcattctagttcttttcttaaatgtatttggcaaataattataaacaaaagcaagactattatcagaactcatgtagtaaatttattaagaccagatgctttcctatatgaccatgttggtggagctgttagtagctttaaaagattatgttcctctgggtaccagcactgtccttctttgagtcaaaggaggttaaaatttttgaaggggatagtaaattcgccaactctccccaaatgaggacagacatccaaatgggaaagcctccttcttagaaacctttgtgcccccctcccacccgctttttttaaagggcagagctcagaaatgggcatgctcatttgatgaaggcagtgccatgataccagaagccataaaaggaaagaattctttggttgaacagaaattaattaggaaaaaatgaggaagaaaagaaaagctcttaagtcagtggcttaaaaaaacgttctaacagctgtaatatgagagaacatactaacacattttttaatataattatatgaaaaagacatttttatatttccctcttctagaataaaaagagttttttgtcaagcagtaacaatttattccttatggaaactgctttattattgtctgatggccactttagatccataaaacgaaatggattaaagaaaattaaacagtatttttaagtgtctacagcttgtggcatgttaacagcaatctgtgtgaaacagtgccaaaaattaagcttaggtttccaagacctttctgtactgtgatacagtgtttaaatactaaacagaaagtttgttttgaaatacaattttgaaggtctcaataatttggaggaggtaagataagatacaaccaaatgcaaatatatatatgttatatattagcattatatatatttcattccgcctcactttgttatagtatttgaaaactttggtaaataaaatgagtgcttttgagagtcagaaaaattacattctaacccagaatttatcactaattgtgaccttagtaagtcacttaaactcaatagacctcagtttccatatctgtagatgagaggatttggatgcctcttctcaaatctcaaggtttctcaagaaaccttgagcatccaagtcatcttctgacattaaattaaacacctagattcggctccatatgtctcaggacagttgatcccctaatctcgtgcatgtctgtcacaggtgtctaacctaccgtagatgaatctcacacattgcaaagactaggttgaagttgatattttttggttttgttttcattttaaaattccagctcctgcaggattgaagttggtcttttgaagtgggtccagtatgactttgtgagctattctgttcttttgtatattattaaatgagtgagtaaaagtggcaaaaagtgaaagatcatgatttgacagtatcacatggtccgggtatcaaaatgctaattgcagaagggaagcatgatatggtgcaatttgagtcctctactcactagagctccttggggcaaggccagtaatagtcttctccaaagcatctggccctgcccagtcctagagatgtgcagtgaacatgtactgactgactcatgtccactttgcttgtcacgtgcctctctgtgccatgttaattttaacctagttgctgataattcagtaatattttaaaagctgtatagtataattgagaggattatgttaaatattttaatattttgattttaatcaaaatattgcggcctttaaaagctgtaagactttgggtgaatgaaagtaaataagtaaatggaaatttttgtaatattaaataatcaaaatataaaaattaatacaatttttaaatgtattttttgtattcactgaaatttattgtgagttatcagtgctattcatctattttttcacttgataaagtgtaacaggtgactttgatgtgtgattcttggtggcctttcttctcccggtgctggaagactatgtaactctagctcagtgagatttttctggattaagtgggtatgattgctcaaatgtcaccagtacatcaatcctttactcttccgtgtcatacaaaaaatattctgtgaagcacagactccataatgagtggacgattttcactctacatactacatccgtaatattgcagccaaccagaaacaccaaagcttatacttatttagatgtatgcacataagaaagtcaaaagttagggggaaagatccactgggaaactagatatggagactgtgtagcatctgaccttgagacaagaagactgatgtggggcgcggcacaaactcctgggctcatttctgaggcttttccaggcatatgtctgggtgagcatggtctcagttcgcccccacacatctcagaagttggtggtctggaaaacttccaaaagggtgtggactgcagtttttgaagaagcataattagtcatgcccataaatcagtaggcgtgtgggtgtgtgtgttgggggtggtgggggccaggctgcatgagtgtgctcagatagccctggctggcccacagtggtggccttcctgagaactgagtagtgccaaagtcctttctatccagaattatctcacctatttagagccaaatttatgcgtaaggcagacatctgcatctttgaaaatacaattttgtggattttgcctttagggtggtttttgtttgcttgttttgttttgggaattctaattttcttacgaactgttttctcgtttcctttagaaaatcactgaaatgactaatgagatgggaagatgaacaagtattatattttgagttctttcctacactgtctcattttctataaacatactaatgcatgcttttaaattgttaataaattggagttttgctgcaaatttaaagaaaaagaaacatttcctcattttggtctttctttttttgcccttacacatgaaattctagatctctggaagggactcaacaaagctttcctaaattaattggctctgacggtaccttcttaaggatttctggtgtggctctgacatataagcaactcagataactacagaaaactgtgtgtaaaaatcagcccaccagtatttgaaacaagtatgcactgttctttctgcgtacctcccgtctgaaaccttgcgctaacagccggatacaagtacaatttctggctcctcattcagtgaggttagaattggacgtcctctaagtacctcatttcatgtggttcatgatagcagagtgctgcaacaaggtttacaggacgacggaagccagtaatccgtttataactgtactcccatgacaattaacagaccagtggaaatttgagaaccacatttacctggaggggtcaaatgtaaatgtccagattgtttccaagctctgacttttcttttttttctcccattatactatgtcttactaaataacattttttattgaaaacaattaagggcaatttatgatcagtgaaataaccctggcataattcacgttttgcccacacaaagaaacacattgaaaatgggggcaaggggcatttgaggatcctgaaagttcatgttatattgaagaaaaaaattattttcatgtctcttacgctttgaaattatactctgcttcatatccctgatattggtataggtccaaaaggaaatataaaattacttgtctatttattgagtacctactgtgtgctaggccctatcctaaaatccagatatcctggttaaccattttagccctgtgttacaaaattccagttgatttctgttcagagcagtgacaggattttaaaaatgtatgctttgaaattattttataaaaattttcattttgtgattagagtattattaaacttgggtgataaagatttcagctttactgaaatgtcatttgtataagaagagcttgcattttggggcattcatttacgtaaagattgagtccaaatttttcagggtagcattcaaagctctctttaatatgaatccatctttatttcttgtctactgccaactcatcctttgagctattcagaggttctccttgacccctggaatctgtgtgcctcccactctttgccttttctccggctctctcctctgcttagaatgtccttttttgccatttccagtcaatcacacacccatgattaccagacagtctcagatgccgcctcccttagagtgtcaggcagatcatccgtcccattgctaattcttctcccttctccttacgtacatgttacatctcccttgctaaacttagtgcggttagttttatctagaatttttttttgattcttttaggatggttagagcctaggtattaggagcactgcctactggtttaccattacatcatatgtactaataaatacttaacaatttttgttgaaatcaccatggactcccagccttccatgctcaatttcaccctgaatactcttagcatgtatcagggactctgctatcagccagagatctaaagccctttttactgggatttcctttcagtgttgtacgtgaaataactgtgttgtcttcaactaaatcgtaactgcattttagatcacagattatcgctgatctacttttgcatccccagttggttactgttttaattttataattgtatgagccaatacatcattctgttatttattacataattaccgttttagagcaagatgcagcaaagtatggtccccaggtcaaatcagccctgccacctattttttttgtatggcctgcatgctaagaatgatttttacacttttaaatagaggggaagaagctccgagaataatatttcatgatacgggaaaattatatgaaattcaaattggcatccacaaagagtctgattggaacaccgttgcacccattttttttacatcttgtctgtggctgctttcatgccagagacacgacaacatacatacgtagcagagtttaatagtttctaccgagggtccacaaagcgtagttactatctggctctttacataaagtctttcaaccatgttgtagagtacttaaaacttattttcttagattgtaaactctttgaagacaaggaaggactatctttgtatctcccattgccctttcaaatttatggctctctggcacttttcagtatttgtttattgactggtttttgatgtattcgctggaagtcaggtttgaccactgtggaagatcaggcaggactactgaaatttgtgcctttcattaactggcatacagtgaacgtcaacagagaatcaaatactttttggcttacaacatgttgattattcttgggatagtttggctagctttctggtatgtcattctttcatgttttacagaaaatactaattctcactttgcagtgtggtttccatttattccctagggtgtttatgcattagttttgattaatggaatgttttctcctttcccaagataagtgtgggggatgcaaccaatctaaattgcatctggtgtgtatgtaggggttgaacaactgctttgtgagttaagcacagttaagtccatggatttggtaaaaaataagtaaataaataaaaaggcactggatctttcttctgcatgccagccacaaagctttcctaaacttctgtctgtggctagaaaaataaagactggatgagaattcctgtgaaatcttgttctgtgtaggcatatgtgctgaaccagcaattactcacctaatcttcctatcatgatggtgttttgtgtgcctgctgaacctagcaataagctttccagtatttctttcatcatgaagttaaggtaagcattgtgtattcccatgagtgtattatttggcatgaagtatacaccatcacaggtttggaatttgaggaacctaggaggatgctgttgtagaaaagtatgtttcattgataaacaaggttctgaaaaatgaatggggagaatatgtcacgagtataaaaatgtgtgtaacattcattaaattgtttgttaaataatgtattcagactgactgtgtttcccagcctctcctttgcccgttatatgttctagtaaattaaagctcggaaacctttgtcagagttataatactcaaactgacatctaattcccccggacaataggtacaagactgcgagcctctctaattctttccagtctttacatttattggttcttttgtagacctgtttcattcaatctattacaaacagcactggttaaaagtgtgaagtttaccacatttgaccggaggcacattaaaaaacaatagcgtcctggcgtacattccatgcgtcccaggggtatagctcttcatctgagcagcattttcatctataattactacattagatttgaagtgctggcttgattaaaaagattgacatgtttattttttggctgacctatttgggtagatgtggatttgattcatctgttttgtgtgaccctgtgttacaaagatgttattagttgagcaagaatcatgttttattttggagtcaccattttagcatagatttgaaatgcttttattatagttacataagaaatggtaaaagttgaaattttttaaaaaagaaattatgtgtgcactcacccaggtatcataaatagaaatgtatttcagaatggttttcagagttcagtattattgagattgttattgaaacgtttataaatactgcatcaaatggcgtccacaacttcatggcctacgttaaaaagctttcaccagaattaacataatctattttttattgtgcaccattgctcaggattatgccttttctacacatctgatgttgtaaaacatattgtgtaaataattgataataaacaaacaaattctacttttgccctggtgtacttcaccagtttcaagactttgaagttccttaaataatttatggcacttattagtgcaggcaaatcaaatggtatccttgatccgagctgctttttgtcctcgttgtttctgagcagaattgttaagtgagccttctgattgggacgaagctgagtaccgctgaaaatcactgtggcattcatgctgatgtgtactgatgcacgcgtgttgccaaaccttcggtatttacactaatggaattcgcagggttaccggaatatattctgaaactaggaattgatgtatcttttgagaaagagaaaaacatcttttcaccagcacgcttttagtttacctatagcttcttccacgacgcttcttaagatgaggatttcgcctcaatatgcactccttggctaagatacaagcctgctgaaaaacatgaaccaaaatatcaaaagacagattatgtgatctttttttaactcataaaagcttaggcagcatgccagccagccagactaaatactctgcaatggtacaatagtcttccttgggtgtggaaaatgtaaccctgtgatgggagacaagtgaagtttgagaagttatgaaagatttatgacaaacatttttttctcctcacggtcttccgtgttatttataattacatgaatcttaaccagaggttttattgatttcataatgaattcaaataaagattgcagctcctcagcgacctttaaaggttagactggctatgcatgtttttttccaaaagtttttgtcgtgatagaatttattttttaccatggaagtattcagacatagtagggtcacttcagactgtaattatcactgcaaggcttatgaaataagtgaccaacacagtctctatcacacacacacacacacacacacacacacacacacacacacacacttatatattcagaggacttctttataatagttctattcaagcaagccatgtaggagaaatgttgtcacttttgtgagggcatataacatgagcaacctataatggatccctttttttggtgtttgccatctcttagagagatttgatttgcaaaggaagcccccaaaacgtgcctgttatccacacgaccctgtatgtctagggcaggccttgatggctgatcaacctgtcttgaagtgaatgagggagaatattttaacgtggaatgccaccttaaagcatgactttaaaaaatatcttgaggctgggcctgtaatccgagcactttgggaggccaaagtgggaggatctcttgagctcaggagttcaagcccagcctaggcaacatagcaagagctcgcctctacaaaaaatagaaaaaattagctgagcatggtggtgcacgcctgtggtcccagctgctctggagcctgaggtgggacgatcctttgagctggggaggtcaaggctgcagtgggctgtggtcacaccactgcactccagtgtgggtgacagagcaagactctgtctcttaaaaaatataaaaaaaccttgaaataatagtataaatacaacttcgctacactcagtattaattactagtcataaccctaaattaatttgtcaatatgccatgtaaagacatttaaaaagaaattcaaatgccaaaaaataaaagatttgtactcgttataaacattaactcacttaacttcaaacactaattattactatttatgaaggaaatcatggcctccattatattctcagaaaaaaaaattctctaaccttgaaaatctatccgaggctctggctagacctcaactcctgcaagcagcttgtaggtttgaaatcaataacccttctggcaacttcttttcagggccaagattaactgccctagaaagagaacttatcttggattgagcttcagaaaggagctaacagtcctctttgggctgtttttccctagtgtctcactgcttggagtctcctaagcattctccctgcaggacaccaggagaaaagagtgttttcatccccacgccatcccccgtgcggagtgaatgtacctgggctgtggtagacagcacacctgcctaccatttccccggagtctcttccgcttgaagatccaaaccagtggacatgctttttggaccgagttgctaaggatcatctgtttcctagatgtaacattcagatggttcaggaagatgtgtagcgtgtctagattccggacagattggaagtgtagcatccagaaagtcagtgtgggattaccaattcagaaggttggtaattcaccatagccacgcctcatctgagaggcaggaagtgagccaagtaggaagggtaagcctcttctcaagggtcaaggcaagcaagttctgggtggcaggaggtaagcctggccctggacaccaggcgcctcaccttccccatcttgttttcaccgtcattgccctctctggctggaaagtctcatttgagcttaagccctcgggtgtagtaatgtaactagggctgattgtggagaggacctgtgccctggttctgctgaagattctagaagctcctttaaccttatactgtgactttaagaaaagttgtgatcattaaagtttttctttttcttctttgtaacattttctacacatttgaaaggaacataccctgatgtttttaaaacagtcataccttgtcagtttcacatctccgtaccaaaacccaaaacctaaagagcatggcttcttttgactagaattcctgcactggtccttcttgtttcctttctctcgtcctcaaatgtgatgcatcatttccggtcatcttctcggatgccaaggagctcaggacctgactccttgaagttgtctttctccttctctgccattgttcacgtttcccatcctcggagttgctgttgcatttcatgtcagcatgttacagtttcacaatttaaactccttctaaaagttctctggttctactgatgacattatttgttaatctatttcctatacaaataataagctgtgtttctattatttttgttgtctacaagctttttaaccagttacactgcagcgggcgttcagtgtttaacattggttagcctgattttcctaagtgaattgtttgcatctacactcaaagcttggggttaatacccttgctatttagtatcttctatagcagtaggttgaaaactatgccacgataaccctgcctagccatggagggatgtgagatagggaatagccagttgtgtttgggggctccactcccaatttaacaaaagaagttcaggggttttttttcctctctaggagttcatttcaccatcagaggatattattcagaggataaaaaaagtttccaaaccactgctttaattacttaataaatactcaaaaaataattatcccaccgtggtattgcatagggaaataataagttgcagctcaacaatacaaaaagaaaaaaaatgtgtaaagggccctaaataggtactgtggtaagagcaaagtgtcttttgcatataaatggtttaaatagtgacaataactttagttttgtcagatttagagcagctacctagttgcatataatctggagtgccctttcagtaaagtttcacagcttctcagaaatgcggtgctggtttgtcaaccctgttctcccactcagcaaagagataaagatctggtgggaagggctcagtggctcacgcctgtaatcccagcacttcgggaggccgaggcggtcggatcacctgaggtcaggagtttgagaccaggctcgccaacatggtgaacctgcgtctctactaaaaatacataacttagctggatgtggtggcacgtgcttgtaatcccagctactcaggaggctgacacaggagaatcgcttgaacctgggaggcggagcttgcagtgagccaagatcacaccactgtactccagcctgggcgacagagtgagactccatctcaaaaaaaataaataaaaaataaataaaatttaaaaaaataaaagaattggtgggaaggcctagaataggcttctgaccctgggccgtttactctgggcaacaatatcttccctacacattctgcagattagaggttcatttgcacgaataaactctccttccaaagggaattcctgtagagatggcttcgtttatcagccatttacaccttaggttgtattactttaatcaagtaatcagattacttttactgagggcagggaccttttgattgattgggaataaggtgcagcactttgtgaactcaaggcggtgagaaagaggtgtgcctcagtcggttgtcagagcgacactcacatcaggattggctttgggattcagccaacccttccaggtattggggtgaactgtgcagcttgctgcggatagcccgctactttggtgagaagaggaaggacaaatatcataacacctaaattacaaatggccctgggatgtggagcagttggaatgaagctgacaggaaaagtcagcggcaatggaaataggtgcaggcgaccatttcctgacgagcaggtgtcaggtagtgcggagtggatgcggactgttttcagctcctggctcaggcctgggctgcagagagactgaagacccgatgatgaaggacagagcagagggaagcaaaggaatgacaaatatcatttgagacaggtgtaaaaccatggtctgagacattttgtaaagacacaagtggaaatgaggaaggagctagatggaaaagaggattgggaggccttcccatagaagaagacaaagtcaaattataactgaaaaaagttcttaacacatgaaagaagaagtaggcccttgcctacttctgcctcattttgcaaaccagatgaaagtgtatgttagtaaactttgaacaacaaatttcagtatagtttagatagtgttgggacacagttgagaaagctagctggtagaaatgctgccataagcctaggaagtaccggtgtggggactgaatggtgttgactgatcagtactatacctgaagaatcattgcacatttcaggccgggcacggtggctcactcctataaccccagaactttgggaggccaagacaggcagatcacttgaggtcaggagctcaagaccagcctggccaacatggtgaaaccccgtctctactatcccagctactcaggaggctgaggcaggagaatggcctgaacccaggatgcggaggttgcagtgagccaagatcgcaccactgcactccagcctgggcaacagggccagactccatctcaaaaaacaaaaaaaagaagaaacattgcctattgcccatttcattattcagtatcttaggagcaaaaatcattggtggttagcgaggaagattaaactcgcccagatacaattttaaagagttgaaaatcgacccatgaaaaagtgtgtttttgtatctctgcttgtgttgttagaaaaaaataatagctcagcattcaggttttctacaggtgtgaaaatccaggtgcaagttttaaatcacttgacgtggtactatagatacatgtaaccatagatggctttgtggaacatcattgctttttttttttttttttttttttgagacaggatcttgctctgtcgcctaggctggagtgcagtggcgcaatcacagctcactgcagccttgacctccctggactcatatgatttctcccacctcagcctcccgagtagtggaactttaggctcaggccaccacacctggctagtatttgtactttttgtagagacagggtttcgccatgttgcccaggctggactctaactcctaggttcaagtgatctgcctgcctgggtctcccaaagtgctgggattaggcatgagccactgtgcccagccgcatattttaaggtatacattgcttgggttttatcaggatataattagtcattcagtttatggaaaaatttatattaaacagacagtggtctcaaaggaaggctctaaaaggtctagaaatgatacatagggggcggaacaacatgggaaaatatccgtgtttcttgcataatcatagaaaaagaatcagtctaaatgggccagttctcttttactagaaataatggtgccaaaataaaaacttaggtgttagaaatagtattattgaacccaaatcatctttaaaacttattccactgactcagaatcaaacactgagaataaagggtttaaggtaaaagaaaatatatccaattcacacttcaggaaaatgaaaataccacagaccaagagaacattcttattgagctttttttcagtgctctcaatttaaccagctggaattatttttaaagtacatccaattcaaccttttaaaatgacagatttgccttttaatgggaaatatgtatttcatcataaagacggagcacagtgtccttggctaagttattctctacagaaggatgctctttttttgtactctgtgcttagcctataagaaagaacacagattatagaaaattagctcctggcatggaagattagaagcatatagacagactgatagagaacaattaaaaatgcaaactgttcctttcagtatcctgaattcatagggtgatgtcaattgctatgaaatgagccgttcatacaaacagaaccagccaaggggaagaataactttagaaactagagtgccttttttttttttttttgagatggagtctcactctgtcacccaggcttgagtgcaatggcgcgatctcggctcactgcaacctccacctcccgggttccagtgattctcctgtctcagcctcccgaatagctgggataacaggcatacaccaccacgcccagctaatttttgtatttttagtcgagatggggtttcaccatgttggtcaggctggtctcgaactcctgacctcaggtgatccacctgccttggcctcccaaagttctaggattataggtgtgagccaccacgcccagcctagagttccttttttaattaaagaagagacaaccactactttaaataaccagatagtacgttagaaaaagtcaatcacaagctctgttatttggggactttttggtgtctcactcaaggaacctcttaaatctgtattcattttaatgtttttttctttttttgtcggggacagtcaaaatcatctccaatttctaaggagaaacaaacaattcactgataacagtggagctgaattaagcaatctcagtgtttaagttagtaaaacagacacattttcgattaagatgaacagtttcgagacataggcctgactgatgctgtgtgacaggacaggatctgtgagctgtgagtggagggtaaacattccaggactgtgcaggtgggagagggtgaggtcaaccagagatgctcattcaaaatcagaccttggggcaggagttgcgagcagatgctaagggaaggatccaagaagatccaggggtgggggcagcggctggccagcaggagcagcggaagggggtctgaagttattcccatggcagggtggggggtctggaaaggcaagcagagctactggaagccccccttaggttagaaacaaaatacacatagcattcgtctcatcatggggctcttgaagtcagatatacttcagaacccactgcctctgaagaacaaaacaaggattttggtttgtcaatggtaggcatacttgtcttattaattctagtactgaaatttctggaaaatgttaaagagtcttttaggaaatagaaaaataactatgcattttcaggtattttggtagaaacaccaccccagcatgctttatctacacagtctccaaagttctttatgtaatcatagtaacaaattggacaaccacttccaatatgtaaacaaaaacccttggtatgtgtgaagcacattcattcattcaacaaaggaaacaagcgtctgggcctgtccctgtgccaatgggattggttaaaagcaaaatcagaccaggagcctgttccagttgactggaaagcctgagagttttatagctctgtttaactggaacgtgggcttgtgagtggggaaagagagaactaaaattctaaaacggattggaagttcctgaagttcctggtgaactttgaatgcacaactaagatgtgtgcactgcactttttttttttttttttttttttgagatggagtttcactgttgttgcccaggctggagtgcagtggtgcaatctcggctcaccacaacctctgcctcccgggttcaagtgattcttctgcctcagcctcccaagcagctgggattgcaggcatgcaccaccacacccagctacttttatatttttaatagagacggggtttctccatgttggtcaggctggtctcgaactcctgacctcaggtcatccacctgcctcggcctcccaaagtgctgggattacagttgtgagccaccacgcctggcctgaactgcactttttaatcccaggtccaattccactgcttcgcttacaatctgggactctgcctcggagtgaggcacaggggatcttgctgctgggtttgcagggccagacacagaatgtggcagagagagagagagtgcccatgactaaacctaatccacagctgggcaggcagaggggaagtgcaggcggctcatccagagaacctgtgcctgtaagggcagggcaacattgtgaaagatcaagagggcttgaggaagagggtggatggaaagcctacacgatccccaagccctgggagacaatgtgtcattatgaaaatgggctcaggccgggtgcggtggctcaagcctgtaatcccagcactttgggaggccggggcgggtgggtcacctgaggtcaggagttcgagaccagcctgaccaacatggtgaaaccctgtctctacaaaaaaatccaaaaattagccaggcgtagtggtgggtgcctgtaatcccagctattcgggaggctgaggcaggagaatcacttgaaccagggaggtggaggttgcagtgagccgagatcgtgccattgcactccagcctgggcaacaagggtgaaactccatctcaaaaaaaaaaaagaaaaagaaaagaaaatgggctcaaatagaatcttttggttccttctcctccacccagctatcacataaaataaactcacacccccaacttcagggccacaggtaggtagcgtggtaaaagtttagggcattggagagaaagattaagtgttagcttccttcaccatcccctggccagttcccagtccccaaagtggtagaagttgatttctcaaagaacagagggcaaagaatgcctcatgatttttggagcgctgagagctgtcttaaggtcttcaataaatgacaaaggcagttgggagacttgagttcctgtttctggggccaagagtttaagccaacagacttgagttggagcagcggttgctcttcctaactccctttcccccgctttgctgggcctgtatcctccctctttcccaacgcctctcccgctaacctgagagggagagtagggagagttttggtggctgcactggagggatttgctacagttcttgctccattggagtgtctttggcaggtggcccctcatcgtgggcacagcctcacaacccttctggaaggacatctgctgctgaatatcaccattgcctgggcatatggcctcaggcctccctcctaaacatggtggaagcatacaagacctcgtggaatcattaaaacttttagagcaggggaatgacagaaagaaggagaaatgtttcaaggaagttaatttcatccaagatataacatggattcgagaagggaggtgtttcagaagctgtcaccatcaagggtagacactaatgaagcatcagagcgccgacagtaatggatagagggctggataatgaagggggaaatcaacagggctcagtaatgagttggctgcgggggacaaaagaaagaaaagagtcagagattctgatgaggttttgaggctcattatgattacgaaatgtaaggaatccagattttgctggatgtagtgtgtggtgataatgggctctgatacagatttcaaatggtggtgttgcttataatgctgactgaagcggtgttatctttaggctcatgtaagagttgaaatgtttttggaatgtgtaatacctttattttaagagtgtgtggtacaaccagttgaaaacctgtgaaaacgtttactccaaactaattcataataggttgtttttttggtggggagaggggaagagtgaataattcaaaatgagtttattttgaaaatacccttgcaataaatacgtgatcacttttgagcttctttgcagaattttattagacactgtatacacccctgcgtcttccagacactatttttcaactcaggttgtctcagtcgttgcctcccactgtctgttctgctcagtgcctcaacgtagtcagcacatcgtggtcttttcattcacacatttcctttcctgaccattatttatctaagggacaccttgtatggctcttgcagattcctgatagccttttcctgtgatgcttgtacagaattcaagcattaaattcattttcatgaaaaacaatgaaatgcaaatttaaaaaaacccaaaagaaacaaatctctgtgttcaatgaagattacagctttactctttctatatacaaatgtatatgtttgcctatagagattgcatttggagatttctctaaaaagtaacttcacataagatattcatgacaactgagtctgcattgttctccatttcccagcaagctttgtgacttttcggttgcagcagctgtggatcagctgacacatggtcccagaagatttgcagtcttctttatgctcattagcttttctgaatttaaaataaccccatcttacagtaaaatacggtttgagaataactctctaatactcactggataatttaattcctccttcggcatctgactttgaaagcccacattgaccgtggcttaaaacaaaacaaatggaaactcttccaccccgtgtctatcacacccttttccaatccatataaatttcacaactgctgctttgtgactattgctctcctaactaaaatagttgacgtaagctaaatgcttctttacatttaattattaaataatagaatctgcgaacctcagctatttgcatgaccacttctagaaacctgggtctttgcttgacttagagcttctctctgtcttcaggcccacctctcccatgtgcctctgacacgcccctctcccagcacactggcctcagggccttggagcctggctcttgattcaccactaacgtatttcctcagggccccccaggtgcagtggagcgttgctatgactgatttacacccagcctttctcctcatgggtgctcccctgggcccccccaaatcaccgcgccacatctggcgacctaactcattgtcaagcttcactttcgctcattgtgcccttggcacatcgttttccagtagacaactccatgaacagttttatttatttgcgtatttatctatttgcaaattattcttctcacatttgactgctatcttccccttgtggaaatttttatcttggaagtttggggagcatcagtggagtacatgtggatgctcccaactcacatctgatgaggaagctgccttcgtacacgcaggcaaagtgcattcgacagaatatgaaaaaattaagccagcggacaattaatatagtgagaagtgctttacatccggaacatggactgcctctcaccaagcattgggtacttcattcttctctgaagctggccaaaagacgtgaaagcaactcactaatttacacgatccaccgaaagaagaaatctgtaaaattaaaaaaaaaaaagaaagaaatcagctaaactaacagatataataggatgattgcttgagttgttcacatttaaaatgtctgtgtaagtgttaaaaatgttgcctcggaaaacagaatagaatttccctgtgacctgaagtgatgggataattacctccctcctcagagcaggtttcctggctcctcatgcccaggctattgaggaccagccctgctctattgtcagatttgttttcctgttttggggatgattgctttccccacagagcctcaggattgctccagctcttaaaatggtaagtgccattgccacctggattccctctcacttagaagcatctcaaggagtctgttatgggccagggggctgctgatggattcacgagaatgtctccctctctgagccttggattcctgacactggagagggattccttgatgaatgccttcgccctacccgcttacctaacccctatgatttgttgagaatctgctagctttctttatggagatgtcaattcctcatgcgtgtcatagacatggagtcattcattcaataaatatttactgagaacctttcgtgttttgtgcttgcttcatgtcagttacttgtgctaaaaaataaggtggtttctattcttttcttcctcccctggaagtcattccagagtttttgtcccttcccaataactcaatttcagattatttgctcaaggagtaaaaaattagcagaagttactgagtattcatctgggggacttcattctagccagagaatttggcatatcagcctaaattctctagacttcaaaattcccgttctttctttctctctctttttaatttgtaaaattcctatctactattattatctctaagtccctgcatgtttgctaatgtcacgcactcaacataagcatgagatgctcggaaatttgtttgctaaatcatctggcaaatggtcttgttgatgtctgctgagctgctcagagcctacagttgttaagtacttattacaggaacccagcagggcaaattaagaaagctacatgtatgcttgttattttaggactattatgctatgcttctgagggggctgcatattggactttctgacctgaaaggacttgctgttctttagtcagaggttgctgcgtggaatctgaatctttgacccggcaacaataaaagtgattatcttcaagggggagaatgtcctctagttgcttttcatagttcagcctgctggaaaatgtaaaacacttatttaggcagctctaggttcacttggtatgtcatattttataactaagctgggagctttttctacttacacattaagttatttacttcatttttaaatgtaagtgctttatctaaacaggactccaaagcttaagctcttagcacagggtgagcatgcttcccagcccatgcaaaaagatatgtggcggggcagagctgttattaaaattatagctgatgctccccctgcttttttggggagtgcatattacaaattgaagctgccagctaagtaacttacacatcacttagggtggattttaaaataactatacagctcctttagtctttctaagaactacttataaagcaaattttgggtgtctgaaaatttcttaatatgtaaaagcttgggaaaaatatgatcaaaagtattttaagtgcattaactttagaactcctaaaaatgccgattttctggaaaacaggaatttattattgtcatcactttagactttcatcttttgtaatgtattgtgttctaccaaagctctgcctttggtaccttcttttggcatcacagctgtgcttaaaatacctttccagcagtttaagttatctcaaatggtcatctggttaaaaatgctgctgctgctgttgctgtaatttacaagagaatgtccttgaagtcgtgtgtttcctcagaagttttgtcagtttcataagccttaaaaatgtaagtgttgcaaaagagagttggcctttccctttctgttgtagatattttttaataatgcaagctgcttaagcacagagttaatgtccaacatgcctttttctagcaggagactttgtactttataaatgctttatgatgttaagtatttgtgagaagtaaaagaacttgacttttcaaaataataaaaagcactgggtaatcaccccattaagaagtcagatgccagatctgaatgtaccttaacacgtcagtttctatgaatatgctcatgattcactttctgggaatctgcctgtgtttctctcatctcaagagcaacaattacttctcatgaagactctagggcaggagtcagcaaacaatttccgtaaagggacagatagtattttaggctttgcaggccaggagtacaaattaagaatagtgtgaaagtattccacacatttccacacattttactgacaaaattttaatatagtagtaatgaaagggtatactttttaaatgtaatacaggtctactaatgagaagaatggattgttgtgggggagagttgacattttgcctaattagagttcaaaggtagcatttcttatcaaaaaccattctgagctcaagggccatataaaagtaggcagcaggctggatttggcccacaggaccatagtatgtcctagaagggggctttgctcaaagtgtgttcttgggagcagctgatttcatgtcactgcggtggcctcttagacctgcagagcccagactccaccagaggttctcaggctcatctgatcaaacctgtgcttgcctctgttgcaacgttggtttagtggtcaaagtatatttcctatcttttggaaatccagctgtcactttccatgacgtccttcaattcagccttcacattcacatgggctcagctgtccctctttttttttgtttttttttttttgagatggagtttcgcccttgtcgcccaggctggagtgcggtggcacagtctcagctcactgcaacctccgcctctgcgttcaagccattctcctgcctcagcctcccaggtagctgggattacaggtgcgcggcaccatgcccggccaatttttgtatttttagtagcaacggggtttcaccacgttggtcaggctggtctcgaactcctgacctcaagtgatctaccctccttggcctcccaaagtgctgggattacaggcgtgagccaccgcatccagcccagctgtccctctttaaaaaaaaaaaaaaaatcgttgttttgacactgccatgctctacctcccatcccatcccccacactcaaggcaggtgcttcccaggcaccttgtgtgcgtgtggccccactgtgcatgctcatgcagtagagctcccgtccccaccactagatcaaagctacactcaaaggctgccaagactcctgctggcagacccagtctttgctgtcctaaacctctgcttgtcctttgacactgctaggagcccccttcgcaccagaatagctcctctttgccgatatatcttaaggtcttaaggtatagccgagtaaagttcttgaagaaacattacctggtggcctgggagaattcttcaggcacagttagtaattgtgtaaatgcgtctgttaccatttgatgggggtattaactgggcttgggagtacagtagctgaataggaccttgcctggggtaggagtctggggctttgagaggtagatggaatctgaaggtgcacgaacatagcagcccgtgggggtactgatgggtattcaattctcaagagaatgagatccaagactggctctctctctcagttgatgagacctaggtgagtgaagtcatctgcagggggaggtggggtagaattaactcattcatgtctcagtccactcctctacacccaggctgtgtcatagagtgtgaggtgtctccgcagctgtggtccccacagcatccacaacctccagccctccccagcctccctgtgccgcatcctccgccatgaatcctgtttcatctaggtttctctttccctctccctcctgccaaatgatgagtgctggcaacactacatgccacaccctgcttttctctctagatcccctgctctcacaccctcgggcggatggacggtcacaccgacaccatcagctctgacctctccccttcagagaggtctcctttacactggtctcacatgctacagatttcacttcacttggattgcaagcattttccttgaattcagcacctcaacattgaaaaccaaagtttgttcaaaataggcttcttttccccccaacccattttactcagtggccttcctgttactctctcctctcaaagcctggaagcctttacttattatgcttctctcactttctgtccagtatctcagtccttcaaatattttgtttgattattttaatcaaattatttttattattttgtatttattatattttgtattattataatcatgtctcttggggttcatctgatttctaagacgtcaggaatttgggcctgattttttagaactgtctcgctgcctccattttccccctctctagtttttttttttttttttgtatcattgtcatattaatcttctcaaaactccatgttcatcaagctgcagcacctactgaggcttccgatgccctgactggcagtagggcctaaatcacttcttttctgctgatctccaaactgcactctattttgccaagcaggtcttccccactcttcctgctcccaactccgcacctaagccccaggctcttctctcagtctaggtaccctctctccgtagaccggtgtgtatcacagaagatgaccctacaaggaaggtcacttgtttagctctgcatgaccataggagcaccatcacctgctgtgtgtccttccagccccttcctataggtggtcttccctcctaagggagtgatgtgtggactggacaaaccgaggccaacaggggccctacccttgtcgctgtccctcatcatctctcctgaattttaagcccgtccccagaggagatgtcaccaaaacgggggacaaggcacagcagcattactccccttaaggttagcttctctccctggaaagaggaaagaaccaggattgtttttaagagtaaaggtagtattcataaagctcattcaacccacgagagacgtggctctttcttgttcacgagaaggataaatgcattacacgcattgttttttatacttttgtcttttctttttctagtagaaatcaaagatggtgttttttggggaacactaataaattagattcagatgagtttctatgattaattatgccataattcaatattaaccactatagtatgtcttctatttatgcggtggctcgcttttctatttgaaaattgcttaattatgtacagaaatgtgtctaaaacataggctatagtctgagactgaatttgaaaagaaatttgatgtgtatgtgaaaatacactcccaatgttaaccacgtaagacttcgtaggctgttcagaaatcaaatctatcaccacctataaaaaatcattatcaattcagcttatttttcaaaagcgctggaatccttacatcaagaaagcagactaaaactgatcgttatgctgaaaacatggaactttatcatgatgaggcagaagcaatatatactatggaactgctttctgatttaccaaatatttattttatattaaatacatttgattgtttttgtctttaattatttgaaaattgatcttttacttaccgtgtgactttgtacagattccttaatccttgcagggcctcaatttattcttctgtaaataggaggtagaacacttaaccgaaaggtttttcactaggaatagtgagtttttacatggaaagtacgtagcccagagcctggcacgtgtgacatacagcaaatggtagctctactctaatatatatatctattaaaccaagtaaaatgtacaattagcaaaagcctatccatattttttaactagtctgaatacatggaattttaaaaaaattctcgccatggtttatgaagagaagagtaaatgcatagggattccattatctctttcctataatttataaaaggtctgtacatttttcaagtgaaaccaagactgatactgagctgtgcccggctccctgggagcttgctgtgatgtgctcctttgcagttaaagtccagccttgaccgccacatggctcccacgctgtttccagagatagaaatcagatacccatagcatcaggcagagagtggaacaaacaacttgaaggagagtgccgcagctgcaaatattgcaccaacaggcaagaacgcgcctggagtctctgcaggcgcccgttggccacctctgctgaagtctctcttgtactcagggctctgactaataataaaaggtcagtgattggaggctgtctttatctcagctacttaaaaaaaaaaaaatttatgtcaagtgagcactttacatgttgttcacccacttagccagtgcttcctttgaagctgaaatagattgcttacataaaatgctcagagctgcctccacaaagtcttctcatgctgcttgcctcccttaaagctgcggcttcctaatcctttgatcccgataccgctgaactctttgagagtgaaacagaaaggacagagttgagattttagtgtgacaagtggaagaaaatcaattttgacttcccaaagatagaacgagtggtgcaaaagatcactggtcccaaatggatgttctctgtcattgtcttgggtgactaaaaatgcccaagaggtacaacgcaaggcagacaataggaggcaatttcttttttctttactcagaaaataaactaagtctgatgttgggaccacattatgaacatctatgccctgaccattccaccgtcccttgtatttttgcttgatgttccagattttaagcactctagcattccactggaggatttacacattgattagcagttaaaagcatttgtctgtaagtttagttggatgactgtttcttacttcaggaaaaccagatcttcccagtaactggcagtcctattataagtggatattctgttaagcttctaaagaacttcttgtaacttatcaagtaatgaataaggcagaatgcatttagtcttgtagttgcaccatatttcaaatatcatgtaacctatgagtcagttcaaatgttatatgtaagtgaaaaaacaggggataaaaagcaacattgaaaagaaattatgtgaattaccatgccacccactaatacgttgcatagtgatttagccatcctttttcataattacactgttcaagatttggttacaagtatttttagcctcagaataaaaccatcataccccaaaaggtgtaaagaaattaagatagcctttccataattcataacaaatgtggttgtttcaaatgtgcttaattattatctcgattcaattcaatgcaatggtgattcattgccttttgagagctgcttgtgaatgtctcattaggaagagctactaaatgatacagtacgatccatatgaagacatatttaatgtcatctcagtcatggaaacactgcttcttagctctatttgcatgccagaaattctgagcgacaaacaaaccccactacgataatagaatttaaaaattagcctatatattttcgctattgtctagagataagagatgcagcttttatttatttttcatgtttttatttttttgagacagagtctccctctgtcgcccaggctggagtgcagtggcgcgatctcggctcactgcaagctctgcctcctgggttcacgccattctcctgcctcagcctcccgagtagctgggactacaggcgcccgccaccacgcctggctaatttttttgtgttttagtagagacggggtttcacttgtgttagccaggatggtctcgatctcttgaccttgtgatccccccgctgcggcctccccaagtgctgggattacaggtgtgaaccaccgcgcctagccagaaatgcagcttttcttaaatgagagaaagaagtatgtgcagtttaggtaagtagggtttaaatctacatgaaaatttggatgtatcaaggaagcataatacatcacttgttagaaaaagcatcatcctagttttcactaccccttatgtttcttaaatatgtagcttaccttgtgatcttcaagaaagcgaaataaatttaactgtaacataactgactgattttgttggacctgacttctgatctatagttcagtgatatccttggaaatcttgaaaagttgaatggacatcagagcttaagacataaagacttattattttccattcttgatcagaaatatttactactatgtttgtggattttcataattaatctttacctttaggagcttacattctatttattgtatttatttatttatttatttatttatttatttttagggacgggggtcttgctgtgttgcccagactggtcttcacctcctgggctcaagtgatcctcctccctcagcctccccaagtgctgggattatagatgtgagcccctgcaccagacaattatatttatttttaaaaacgcccctcatgaagtctgggtaattctctccagatttctccttatcaacaaatttataagagttaggaaaaaaatgatgtaaataaagcacttaaattgcgacagtggttctattcttaacatcataatgcttatgactaaggagcattcttttttttataaattaaatgtattctgtagtgttagagtagatgagggtcagagacattatcagtatgtaagaatgcattgtggattttcctaatttatcacctacagtaattttctattctaacaccctttaacaaaatcgtggcacacaaatgaaattccagttagagataagaaaggtgtctgcaagaccctagtcatttctcgtgattacaggcgtgaaactcaacagtaaaagaacacatcagaaacttttgaagaaatggttctgagctagagtgcaaatgaagtgctgagaagccagcactgtcactggggcagcagggttgtaaatggtattttcaagagctttaatagtgggcaaggacaagcagttagtctggttgactccttagaacaaatgtcattaaaggaaaagtgttgtgcaagtgactgattcaatctttattaatgaaaaaaagaaaagatgacgcctccagaatgaggcagttagagctgaattgtggcgagctctatcttcactgactaaattaccacttcactcgatgagttttttaaaaaacatgcagtagaggtcagatggaggtgttttgttgagctcatcatgtggtggtgttttgctttaaaaagggtactgttttcaactacataattaaaaaaacaaatctgcccagcttcccacagccaatcaaaatgtactgaaaaaatcctcttacgttcatttcattacggaaacagttatggagtggcaaattggaatcaattatctgtagacggtgggatagcagttggggtcacagaaatctatggattctataaggcctaaggtacaaatgtggcaacaggcttttccttaaattcctggggatattgttgttcacacacgggtctttttactcacacctggcacatgtcaacagaataacctttgactgcacaggacattatttcatttcttttctcttctaacttgcaatcaggtttcaagttccactgatgtctcgatacctttctagggttagggctgaactgttttcaggactcccctatgaaaactcgcctttggaagtgataaaacattacaacatgaaaacctaattttgaatgaagggagaagagccagagctggagaaaacgacactaccccctctcccagcaagtggtctcaaagtttatggagaatttcttattctctgctgaaaatcctgtctttaaaatatttgtttcgtggttgatttctccaaaggccagtgaataatccacacgtaatcattagacaccagtggcactccaactgtctgtctttgtatttaccagccagaaatgattgccagcacacaggcctcagaatgtgtggtttccagctaggtcaaactatatccacaaaagagatggaaatattcctgacgtcacatctcctggtggttttcttatggattcaaattactgcacatgtgtgaaagatacctaggtgtgaccagatgaatgcacagttggcttcaaggtaatgtagcctaatttcggctcgttcagtttccacatggtcttgcctacctgccttgcagttccactgcactagatcaacaaattcctggtatgatgtgccatcctttggtacctgtggccactcctgaaaagcagaaatcatcctgatatcagttataatctggtgcaatatcatttacctgtcagtttcgttactccatcttcatcaccaagcctacctgaataggaaaaataaaggtgatgtacgtgtgaggatacaggcgtcatagtctttggaagcaagcaatatacatcaataggaatgttgttgtattttagacattatttatgagaagtttacagagagtacaccataacttccttattcacagttgaattcctagattctagcattgtggtgttcaataaatgttgaactgagtgatgatttctcattcacttgatagcatttgaccactgtgttcagacaatgctgacatacttcaaatcctgaaaacgattcaggtgttttctaaacaatggcagacttgcattctattaaagaactccattgatcatttttgtaaccaaggtgtttacagaatgcaactggctatgattcacaccacttctggtgtaaatatcataatgtataagtatttttctaaatttcaccatcattttctttctttttttttttttttttttttttttttttttgagacagagtctcactctgtcccaggctagagtgcagtggtgtgatctcggctcactgcaacctctgcctcccaggttgaagccattctcctgcctcagcctcccgagcagctgggattacaggtgcccaccaccatgtccagctaatttttgtatttttagtagagacagggtttcgtcctgttggccaggctggtctcaaaatcctgaactcaggtgatccacccacctcggcttcccaaagtactgggattacagacgtgagccaccgcacctggcctaaatttcaccatcgtttctattcataacttacctgcaaagtgattatctgactagtactactgcaacaaagataataaagtgcctgatgtttatatcaaataggatatggcatgtttctgagtgtttctaaagaaaaatactgaatgaacccctcgcctaacctagtgcctgtggtaacaataactgacatgcattgagcgcttactgtgtgccaggtgcttgttcgaggtactttaccggtattaactctttaattcgcataacccttctgtgagatgggtaacattatacccattttacagatgaggaatctgaggcctggagatatcaaatcatgtgcccaaggccacaaagccaacatgtggtagaactgagactcgaatctaggcagtttgttccaatttttgtgctttgaacctgtgcacaatatgactattgctattttgtgatattatttgagatttctcttttaattattcttgatatctttggggcagaaaaacaatgaataataatgttatgaatattaaagccccataaaaagaaaggtattctgcctaacagaaggaaagatttcaattaaatgtggaaagcctatcaatggtgataaatagtttccttggactgcagccacaattaaaggacttgggtgagacagtcatcggagtaacagtaatgaaaaaccgagtaacagttaacatttaacactttctatatgttaggcaacgttctaaggaccttaattacattttcttatgtttaataggtcctcttttatggatgaccaagttccttgcccaaaatcacataggttatgggcagcagagttgagtcctcagtcaaaatatacctgaccccggagtccatgttttgaatcactagtctgtcctgcctccatgcagcagtgtagaaagaccatcttgagagcctcacatcatggtggccttaatctggggcatgtggaagaaaggatgtccttggtctctggtgaatcccgtaatcttctagagatattttaacaggaattataattgaatatattatataggcctctgttactcttccagtttttacgataatttcatgataacttcctgggtgttagtaattgtgcaaattcatatattattgcatttaagctgcctgatgaccctggtgagtagggtcatcttagccccattttataaatgagaaaattgaaaccagagaggataaatcatgtgcttaaaattatgcagtaagtgacttcaaatcttgtgatctttactgttctataaataacatcctaccaaattaggttaaactgtatgggattgcaattttggtgggtcaaaatgatccattattggcaatttcatattatacaacctcattgatgaatgaaagtgaatttaatcatttcttattttcaattttcaaatatattgaaagtgcacacctaatatattcgcaaacataatgtataagaagaaaaagaatcatgaaaatttgatagacccagtgcattgatttgtgtgacagtatactgatattagtaagaaagtggccacaaattatgttgtaattctttatgtccatacatattaaatccctggagtttcttttttaaaaaccataataggccgggtgcagaggttcacgcctgtaatcccagcactgggaggccgaggcaggcggatcacctgaggtcaggagctggagaccagcctggccaactggcgaaaccctgtctctactaaaaatacaaaaattaactgggcgtggtggcgggcacctgtagtctcagctactcgggaggctgaggcaggtgaatcgcttgaacctgggaggcggagcttgcagtgagtcgaaatcacgccactgccctccagcctgggtgacagagcaagactctgtctccaaaaacaaaaacaagaacaaaaacaataaaaaccataatatattttgaagagagcgaagtaattgaagatgaagaaaaaaattcatttctcctagtttgaaggttgtcatcaaatacatttgctcaaaaccacgtaagaattaaaacatgaaagcttccattctaatgatggcagttaaaatccaacccatcaccgtaagaggctgaagcagagaggattgcctgagcccaagagttccagaccagcctgggcaatatagtgagacccctacctgtagaaaaaatttaaaaaattagccaggcgtagtgttgcatgcctttaatcccagctactcaggaagctgaggccggaggattgcttgagctcaggaggctgaggctgcagtgagtcatcatcgcgccactgcactccagcctgggctacagtgagacccaatctccaaaaacaaaaaaaagaaaagaaaggaaaagaaaacacataccatcaggcttctttaaaatccaattttaaaatatccaactgatggtttaaaataattgtttcagtttacattgcaaactcatgcaaatggacacttatcaagtttgactgtcatacagtcaaatgatgaagtctgcttactctcctaaggggaaggcaaatcacctctgttttgggaaattcttttgcatattgtttggcaagattgtacttaaagctgaatatttaatatgcctctgtatgtatttggtttttcagtttcctggaaaacattttacacaggtcaaccgtaagtctggccatattaaatgaaaagaagaactcaaaatgcatgtggtttggccctgaggagcatcttctgatctggtggcttgtgaaaagtcagctttatggccaggcacgttggctgatgcccgaaatcccagcactttgggaggccaaggtgggcggatcacctgaggtcaggagttcaagactagcctggccaacatggtgaaactctgtctctactaaaaatacaaaaattagtcgggcatggtggcgggagcctgtaatcccagctcctcaggaggctgaggcaggagaatcgcttgaacccgggaggcggaggttgcagtgagcagagatcacaccactgcactccagcctgggcgacagagtgagactctgtctcacaaaaaaaaaaaaaaaaaaaaaaaagtcggcttgataaagaagagcagggcctcatctcagctctcctgccttacactgttcagggctctgacggccgatctcttcctcacccttcacttcgtcctacagtctcttctggcatcacgcagcatgctgcgattccaggtccaaatgtggggggcactgctgtgagtccgtggccctgtagattgataggaaactgcgcagagaaggttcatgcttcttgctagccacaaagcaatgaacaggtagtagtattttcttatggatggaaagtttaggtaaaaattgtagtcttatgattacattacatggtattgtataattacctaagaactagcccatgtacagtgtacatttatgtgtttactaagaccatagtttttcccttttttagttcccctttaataactggtaattaatcctgtgtaatattaaataataatcaacagctctgtgaaggccatcatagaaagaatatttttcttctggagagattattgtaagtgttatttagaagaagtcttaagccccagcatacgaaactaagatatctacatatcttttagcagagttttgttttaccccttcgcttaatcagaaataatgaagatttatgtatgtcaagttatttaaaattctcgatgaaaagcatggttgttctgtgtgtgtgcttaagtaccttagctcaaatgcagttacactgctgcagaaaaatgttaacattttgaaacagttcttgatttcacttgtgctgattttatcaaaataaggaggaaaaagacaccgtgcctttgttacatgtgataaacaagcgatttgctctttagaggccccctgctataaaagttagccgtttttaagcctagagaatcaggtgagtaatattagaatatttgatctttttaaggatttgccttgacatttattttgtaaagaccagaaactttattgaaactgagccttagaagagtggctttagcactgtgttgctgtcccaaaatgaagagataatctaggaattggtataaagtggccactacccaaaatctcgtggtgggccacatgggagaacattctagaataaaaataccagagctgaaatcatgatgatgctggcagcctaacacttgaaactatattagtttccatcctttaaatgtagtcttgtataattaactaatacatgttcagctgcctttcaatatatataccatccattttcagaaatcacgatcctttatgtaagttctaaattcagacatttgctaatattcagatgtttaaattaatcagaggaagacatcaataaatatttttcaatctgaaattttaaatccttttaaaaaatcctggcatttgatgtcatatagacccaatctacaaataagacattttcagcgtatcatcagtcttcggcacatattgtatgcaaatgtcatcctctctttgaaaataccttttgcattttaagcaagatcctattttgacagttctttatgctttttggggagagttcttgtggagagtttaaaaaaaagcatcttgagtttttgccttgacatattcatcttaatttgatcatttctcttctgtcacagttaacccctcaatcaaaacacctggaagtccttgttaaagttcaaggcttccatcaacctccatcagcgattccaggcaggaggtttacacatgttaaaccactagaatgtaagttgttcttcaggattgccccggggagttttctactgcatttttgccaattgaattatgatgtgagatggtatgaatattgatcaaatttctaaactgaatttcccaatttttagactgtggtgtaaaccaacccgcaggttgtcataaccaattcagtatgtttttaacaatagtcagtgaagcgtggaggtcttcaaaactcattgaaatgtagaaaattatctgcacatatgctatcaacaaatctcgcttaactccttcctgctcacattccaaaccaacagcaaaattcagatccaagcaaactggtcagtgattctgtgtgtgcttgcatgtggccatgtgcctttagcttcttggtttgttcttcctttttccaggcttatctgtttgaaaatataggaggaaatgtgttaatacacatcgtgaacacagagtacaggagatgggattgtaccttggttagtagtttatcgttgcaaagtggttttctttcctctgaagagaaaacaagaaatcgtgcatcatcataagctggctttccatttcagggccatattttacatttattcagaacctctcttctttctgctttttccatttttctgtctaacttttagtgatttattcttttttattagtacattttaatttacagtgggatgggaggagggccttctgcagttctttgtctgctctggagaaagttcctgaaatgaaacatgaatttgagtttgctgccagtcacagttaaggggccttctcttgtcctatcccgttgtaagacaagctcgtccctaagagagcctctgaatccagccatcctttggagagagtcaagcatggtttatcttctggacctcacctgactggttttacaagaacagtttggtcttggtctgcacaaataggaagcaggttttgacattctgagcactctctccatgcattcagcagcttgtcaataagaatgagagaaagagaagaaagaaaaagagagaagaaactatggtaggggaaaatgaggtggaaagaatataataccttccttactttccttgttttggtaaaaacaagttaatcatcattcatatcccttctcttgcataaatatgtatctgtctactcctacctcatctgctgcagtgaatcacatattttctcctcagaattgatttgggcaagaaagacaatgtatacataaaatcagtactggatttcatatacaacaaaaatgttagagatttcaaaattatataccacttttaataacattttttttttatgagggggtttctaccatttgctaaaagtgacaagaaccattcggcctatgctggcatagaaagcagcagggaaatcagttgataataatatgaataaatgtatttggttgattacatgcttacaccttacagtttataacatgttttaacacacctaatgtgacctcatttgctcctaaaaatgaaaagccctttgaagaaaacagtgttatctcctttatataaatgagaaaactgaggctcagagacattaagtgccatgattaaatcttcatagttgatctttgcactagatgtttctgtaatattgagtgtgtgtgtttgggcatttgcgtgtatgaatataatcatagaacactgctgcaaatggagatagattggcaaaaaaaaaaaaaaaaaaggaatggaattgactggtaaattattagtacttctatctaccacttggcagctaaaggattgccctccgtgtgtgactaaaagcagtggcctgtccagcagatagtttcagtccaattaaagtgatctgttgtgactgtatttgaccagaggcaatggaagaaagatggtgaaaacgtccttccaagattatcctctttcagaatccaaaacttgaatttctgaaaaatgattatggtgtggcttattttatgtaccccacaatatatattatcgaatcataaatcaaactgctttctaaaagattttaagtatcttcggataaatttccttaatattttaattgaaaaatgaggcaatcatttctcaagatttttatttctgatgggcacatgaggtcctttaattagtgtatccgttcttattcttgctgaacagtctcctgaataagaataaaagtgacaaaattagacaacgtatggaaaaggaaatcctggctttgctaattttaccagggagagtagctaggccctatatttctggctggaattctcaaatgggagaaaattcttttcctggcatgtattgggtaacagttgtttgtgtaccttgtagcctagccgactctgtcaaaggtaatcctcccagtgcaataatcctctgctttcaaaggcgaaaactgtgtaaattgaattttacagaaatctttcttaaatttcaaaattattgttatttaaaacgtatatttaacttatttttgcattgcaaaattggacataaaaacaaaccacagtctggccccaggtgaggtagggagaggattgttaggggaagtgtgcacagcccataataggccctgtcatgccaagcttagttatttctgcagtaaggcaatggagtatgcaggttgaaaacatgaacttttcagtcagatatctttttttttttttttttgaagtggagtctcgctctatcaccctggctggagtgcagtggcacgatttcggctcactgtaaactccgcctcccaggttcaagcaattctcctgcctcagcctcctgagtggctgggattacagtcacgcgccgccacacctggctaatttttgtatttttagtgacggggtttcaccatgttggtcaggctggtctcgaactcctgatctcgtgatctgcccaccttggcctcccaaagtgctgggactacaggcaggagccaccgctccctggctcagtcagacatctttaccagttttgagaccatggcaagttatttcaccccctatcctggctttttttcatcagaaggtggtgttgaaaatactcgtctgataggtttcttttgtggattaaatgaaacaaactctgaaaagcctgtagcccaatgcctgttgtaacatgtttgagtactcaatatacggcagcaattattgttgttttgggtctcaggatatatctagcagttaagtttcacagtcatccctgagaagagatcttatcaggattcatctaaacatggaaaatatcagtgacctagagagatgagttggagcctggtctctggatgctgggatgttagctggaggcctggggcccttggggattttgctttcaaactgaagtggccccgatgtttgcacagtccgatgggcaaaacagagcctattacctggcacctgatcttttcagtggtgaattctgtggtacataggaaactggggttgtggcatgtggaatggttaggacctctcagagctggaaccatggggaagtgactgacgacagcgggagatgaacacaaaatgatctgaggcccacgggaggagccttgaggttcgttgagggaaagaggaactgcagataatggtgagatttcaaagggccaaccagggacacgggagatgtctccaaaatcaaggaagagttgcttggagcccaaaggaaaaagcttcaagagtcagggaagaaagtggctttcttatctaagatagcctggagtctgacaaagcagtgggccatgcctggagtgaaggttagaccggggtctcacggggctcagaatttgatccaatctagcagcagtggcagctttttaatccaacatcatacccttaagcagctcagctcagcaacaggcaccttttaatggagaccttgaaatatcatccaagtaaggaaccatcgggaaatacagaccaagggcaattaccctgagtattttataatatagctagaacgttgatcactgttccttgtttgtgagttttcttattccatccatttccttgttggagattttaatctgtaaatgaaaaaggcctgcgtgcctattttcaggcacagcaaagaccgaaaagctgggtggggtgtcctactccttagccaggctgagagaaaggaaattggagaagtagagaaagtggcagcccattaaaggaaagagaaaaaaagaagaggctggattcctaggagactgtgctaagagtgaatgaatgcacgcagagctagcccttgaagcagacaggagtccaagggcaagtgatctatttattcttgattgcctcaatctaggcaccaaaattggacaagaaagatgactaatggaatgtaatgagtttctatttcaacaatgcccaaataggcttctttaacttggttcatcacgaataaagatattaattgagaaaaactaaaataacactaaaataaactagaatcaagctgatgatgagcatatatatatgtaagtaactgcgttacataaaatgcagctgtggattatgaaaatcatcaagctcctcttggtgtctacaggatggagtggctgagtctccagccttttctatggagcagagcctccctccaccttggacccatgctgctttgctctatctatagcaaagaccatacccagtcattactccaaatgttagggaggtcatgcaatagcataagttcactttcattttattgataagacatgtaaatgcagtgctgaaacataaagtgacttgctccaagtcagtgggtccctctctgccactccacctattctcatgaaatactgagatattcacctgacccatacatatagtatgactgggtatggtctttggtcatcatgcatctctcaaaaatggtagagctgcaacagtgcctaggatcttcctgcagttacttaatggcagtttaaagctgtctgtcttaactcatcctttctgccgtaactcctgctgctgctctccttttatcatccagcaacctctatctctttgaatttgtaaattcagttactatataagacagctcaagcagtagacactcctttccatggaatcaaggcacaatggctttttctttcaagtttcacactctgtatttgataagcttcatttctgtccagtgacctcagagagtggacagtgcagtactgcttgcctggcttccccattaatttctcagagctgttcctccccagtgcttaagtggaggtccacattgtcctggaccctggagcttcacccacagtcatgtagccatagggtccctgtgacttcctgggtcccatgccggggtattcaaggcctcaagcctgtccctgattccacgattacctcttattggccagtgtccactgtcggtggaatggctgcatggccatcattattagccacatactgagagttccgtgatctttcccaaaccgtaggcgtcagtggtctctccagtttttactctcagcacatggtttacagtgtatgagtgagaaacaatgaaactagctactaagaagcctcgctttagtctaatttttttcttcgtgtagatgtgcagggctttttttttttttttttccttttcaaccttgttgtcatttcaaaatattccttttttcagtggcttccgggcaaagaagattctagtcatgcatccaaaccactcctgtcccagcagaaaattccttttcaacactttagaatctactttttctggttatattagccctgaggttcagggcttttgaaatttcctttaaaggaacgcatactaagggtaaggtgaatatctcagtatttcatgagaatgggtggagcggcagagagggacccgctgacttggagcaagtcactttacgtttcagcactccatttacatttcttagcaataaaatgtaagtgaacttatgctattgcatgacctccctcatatttggagtgtttttaagtcaaatatacagagattgagaataaaatagtggtaaccaggagcgggttggggcaggaggaggaaatggagagatgtgggtctaaggatacaaagtagcacatatataggatgaacactcttgagatctaatgtgcaatccgaggaccacagttaataatgttgtattgtggtggggatttttgctaagtgagtagattttagctgttcttgccacaaaataaaagactgtgagatgatggatactttagcttctctatagtaaccattttactatctatatgtgtctcataacatcatgttatataccttaaatatatataatgtaatgtaatgtgtgtgtgtgtgtgtgtgtgtgtgtgtgtgtgtatatgtaatccctcccagctctaaaatttgcaactccaaggttgcatgttggaaattggacaactgagtcattaaaaataggtattttcccttcacatcccaccctattgatttctctcctggtgcctgttcaagcttcatgctagggtctaccggttcaaagaggagcatgacacatgaagtcagtcttgtcactgctaattggtgtcttacatagataaattatctagttatcaggtgtctcttcatttcgtgacaacatagcatcaagaaagttcgttaagaatgcggagaaaatgtatttttatattcacagttatttttttaggatgaaccatcaagcttttgagggacaggagctgatttcagaaattcatccttcactcctagcattatggtaggatttctatctttgttttattctgtcaaatgatggatttttgtataatgactaaaaggactgtgtaaaatgccattgtagacttcagcacaaaggtactgacatcttttcctttgtggtttagaagcctgaagttttgtgcagtcctactgtcatggggcatgtctcagaagtcactgccaagctacacccaggttgggctggtggatgacactgacagccccgtgtaaataagtttctaatattgttaatgatgacttaaacacccaaatatatttgctttgtattttgtttccttgcacttcagaaaatatgccgttgagaacagctcgatggaatttcattcaaactttcttgactttacaccagcagcattttcatttcagctttaacctacttactattttttttcttttcagtaaacaaatatactgccttatgttgaggcgaggacttgggaggagtttcaggaaaatcattcttcacattttagaggttgtttgtaataactttgcttatgctataaaaatgttaatagcttttgaagaataaaaaccccgtaataattgctcatctataagcagagtcttacggttttagctgcaatctgtggtcccgagtggggaaagagtaacataataccttctatttatgcatggtttatgaactgatttgcacaagggactttgtatttgtaaaaatgcatctcacttgctatgcattttaaccatttaatatttgatttaccaagagagcaaaattttgttttcaaaatgcagcaatatgaccttagactgtgtgtgcgtgtgtatgtgtgtatatatatgtgtatatatatatatacacacacacacacatatatgtatatataattaagcctgtcttaaaagagtttcaaaagatgactttgtaagaagatcaaaccccaactacaggtcctcaggcattttagtaactcatagagcttaatttccatttctcttgtgataacataaatcataataagagtaacaaagaatttccttaatgaattggttgaatacagtgtacataacattgaagaatgtttccaattctaaaatttggaaggatggtgtttaaaggcactgtcgttagttatctcaacaggtggtagctggtaattgataattatatttaaagtatgtgtattcattgtggttggtagtaatacagcatttttatctgcagatctcaaagcatgtgtgaataaatatgcattatttccctattttaagtagccagagactcactgaacgttaattagatataagcagacagagaaatttcatgtccgctgcttgcttgatgctactaaaaaaaaaaaaaaaaaaaaatcttcccagagactgaggtgaagaacacagtgtacctgatctctaaataactactgttcaggggcatggctccagccccaagcgaagccccatgaagcgcaaaatgtccctgcacacgtcttccaccaggctcctcacacctaggctcgcagagcattctagcaagtcttaggtcagaagagacctcagggaccatgcttctgagtcctttcctattacctctagctactcagcacgtgcactaggatggggacgtgacgtttcctccatcctccacagcacttccttctgaaccctggcgaacctcttgattaggagaatatttgttggaatacgtactgtgttgtaaactcttttctaggtgcttgcaatagagcagtgaccaaaacagacagtcactgctgtcacagcgctggcgttccaggaaggaaagatggtctgtgccgagcatccctctatttattcacagctttaacctccccatctgcacccttcctacgcaaagcagggtgtcctaccttcttcagcaaaggctttcccatcccacctatccccatcagatggggaaatatttctgagctttattttctggagtttgtattcttttaatttttaaattttgtgttatgaaaacaatagctatattaaatacagtttctcaaactatatatatatatatatatatatatatatatatatatatatatatcccccttctacctcctgttctccgataattacagcacacgaagaggcaggtttccccagcaacggagtgggtgcagccctgcctcataattctcctgaccaacaagtgtctctcctgggccagacctgagggtctctaacactcagtggctcccagctcccaggcccaagcttgttgtatgctggaaggaggggaaggttgactaccggggcctccttgtgttccagggtcagaagaacctctgaagagcttcctattttttcttgttctacatctttgttcccagaaaattccagaaatgtttttctgattctagttccccaacctccatcctctttctttgttttccttggtatctctgaatgttcgagggggtctaagctattcccgaggagggtgcctgactcattctgaccaagtcctaccagaccaaaaagtactggtcttgggagctgcagttgagtcagattagctttgattgtcaacttagataaccccaggagaacaaaaaaaaggaacgcgtagaggtatttatctttggcccacagcctcttctagcatgcataattatgtctgttattataaatatgggccagccagctttgtgataagtcttgcttgagtacactaaactctctgcctccgtgcccatttgctcagctttatatttcacgggcagctgcttatgaccttaaaaagtgcagagaaccctggccagcagtagaaggttctggccaaagggtgatgcccagggcaggaatgttcctgcctctcgccccatgaggtcctctcagctgtttcaggagtgcctcctctcctagaatagcagtaacatgcagctgatgactgccaacaacatcatgctcttggtaccaggctggactctggaacagctggcatgcttgtacatccctgacattccgagcctgggatgcacccgaggttaaggaaccagcagactcccaaagaattatagagtggcatgcagtctctgccagccatttctaaagatctgggtgtgagatgaatctgcagaagggaaaataatggctggaaagcacctgaaattaagttggctggagtcctgcctggtttgcatattttttgtatgtgcctgtgatatgcattgaaaatcatttgcctaaacttcctgctaactagaggtacaattaaacacttccaattcaggagtcccgttccccatactacaggcatctctagctgttttgttttatcttgttttgaggtctttggaaaaattaattgttggtagcgtatatacaaatgtctattccgggaactggcgtcttcactcctctgtccttctggctgaaagggctcggatttcacttttattcagggccgtaactctcacttctcacttggccaccgtgttggtcctggaaagaatcctctccttcatttcagccgaggaaagattaaggaggaaagggaagaggtactggagcacttgctacccctattatcagatcagatatatgggaactttagcaaaatgtctgttgtatacctattatgtacacctaacaaactggtgattgtccagacattaaagacatatatacggacaaacgcgttggctcacacctgtaatcccagcacttggggaggccaaggtgggcggattacaaggtcaagagatggagaccatcctggccaacatggcgaaaccccatgtctactaaaaatacgaaaattagctgggtgtggtgggaggctgaggcaggagaatcacttgaactcggagaccaaggttgcagtgagcggagatcgcgccactgcactccagcctggcaacagagtgagagtccatccaaaaaaaaaagacatatatacatgaattccccccttctctgggggtatgtgttccaggacttccagcagatgcctgaagccctggatagtaccaaaccccatacacaccatgtgttttcctatactgtaatgggtgggtagcttatatggcatggatatgctggacaaaaggaggattcacattcctggcccgatggagcaggatagcatgagatttcatcacaccactcagagcagcacgcaactttaaacttacagattttttatttctggaattttccatttaacgtctttggaccatggttgaccttgggtaattgaaaccacaaaaagtgaaactgaggataaggggagactcttgtagacatgacagcctcagaagtgcacaggagaggggtctccaggcttccagatcacccagaagccgctccagggacctgaagccagagatgttcccaccttccgtgctcagccaaacaggagccggagagccccaaacagcggtgagggaatgacagaaattcccggatgcctcccactaatttctcacaggagaaagtaagacttccaggcatctatcctggatagacgtccacacatgatcccacactggcactgttctgcatggtggcggctcctggcctgccaggcaaaccaccctgtgtgcattaggggttaatttgacttgggaacctgaccgacgtatgctacaatttcagtgggaaatgtgcattccaaattcctacaagactgcctcaaaacaaatttctgaaatgcaacctgttcgtaagttgtggcttgcctgcatttaatacttttttggcagcaccatacacttacaaaactgtatgctgcttatggaagaggacattctggaaaccacttaaaattcacagaagtttggattctttctctagcatatatttcatttattttcttgctgtatatttgacacgtggtcactgttacagcttatcgtcaagcagatatgccagcactatcttcccaactttgggtaaattcttttaccaaaggacaatgtcctaggtgacaagatatttccagttttttcccattgaacaaaaaaaggaatcactttagaagggactgttctctttcacttcagaggaaactgcagatatgcaacatctggtagaaatccctcggattctcttggatgtaggcataggcttttgctccaactatctgggatggttttctcttggttaagtcactctttacgcctttcggcttttccagctttccaggcgtctgatttttgttattactgtgtttcaacttggggagttgtgacacgagtggttgattcctttatcggccttagtagccataggagcagagctggtttaggggtttagggtgtctgacaaatgcagaaacctccaagttcaccgtgaaagcctggctccctcatggcacctgtcagttctttccacgttaacaacccttggattgtcagtctctctctctctctaacctctgtcttagaggtgagaatacaggcttactatccacaaaagttcgttcatccacagagcgagtggcccctgtgttctgagggaatagtcgtacagagcacggttctctccttaatcacggtgctacctcctgccccacacctactgctagtaattatttgcatgggagctaaattcagcaagaatattcacctcaacaaacctactatgtgtgaaatactgtgttaaatgctacagttagaaatagaaataaaacacagccctgtgcagtggctcacgcctgtaatcccagcactttgaggggccaaggtgggtggatcatttgaggtcaggagttcaagaccagcttgacctacatagtgaaacaacatctctactaaaatacaaaaattagccgggcgtggtggcaggcccctgtaatcccagctactcgggaggctgaggcaggagaatcacttgaacctaggaggcggaggttgcagtgagccgagattgcaccactgcactccagcctgggtgacagagcaagattccctttcaaaagaaaagaaagaagaaaaaaaaatgaaagaaaacacagtcgttattctcaagaatgtgagtgagacaggcgcaggtagactttaatacagtctagtaagtgtactgatagagatataccgaatgttatggaaaccacaggagaagctaacttgcgggaagatgggataggggagactccctggaggaggtgaaatgagcctgggctgcattttaaagggtgcatggaaaacaggcctgggaaggacattttagaccaagaggtcactgtcatcaaagctgagtcagtcagggcacacacatagaggcagtgaggtgcttcactggccaatacaaaaaaaccactcctcagtattcccccactctgccccgccatctttggacctcactggaagccagtggccctcatattctgagtattcctgtgggcaggaaacatagttgttgggatgccaaacacttgtgcttcttatagctctgaaatgccttgggggcacagtagtgattctggattgaaagcatgtgggcatcataggaaaaaaatattaataggttaaaaatgttctccaagtctgtgatctcagatatctcaaaatatatgtggttaggcgtggtctttctgtggaacttgcagcaaaaatctaccttcccaggcggtggttcttcaggaagactgtagcgtgcaatctccagtgttagtaaagacagatgttgtcttgtgattcttccatgcaccaattctgcagtttctaaagagtagcagaactggcctcggtgtgctccaagatttagagtaagaatagcagagagcaaacagcaagctggaactactacacatgtacacacgggagccatctctcacaagctggaactactacacacatacacacgggagccatctctcacaagctggaactactacacacgaccacacgggagccatctctcacaagctggaactactgcacacacacacgagccatctctcacaagcaaacatgctgagcacttgacccaatgagatacaaaaaccctggcgttaggaaggaggtaggagctttatctgtgcttgtgttcattcaggcagtgaaccatttaggaaagaattgttgagcacctaccatgtgtaagcactgctgtagtcactgaggctagagcagtgaacaaagcagtctaaaaaatcccctgtcctcttggagcttactgtttaggggaactttatcccaagggcaaagagaagcattgaaaggtttgatacaggcaagtgacatgaccagattcacatttgccttggctcactgtattgagaaatctgaaggaaggattgtttgggaggatagtgaaggaagaaacgggagcagagtccctttaaatgcaggtctaaccaaccaaaagcttcaacatgttacacactgtttcccccaagagcaaaaatttcctgagatttttagctgttgtttaaagataactaaacaagtaatatataattatcctgagctttgtgctttacactgaataagacatcatatttctgcagttaatacttctgaaataacaagtttaaagaatgcctcctgatagacagctttctgcaaatacgcctgcagttactctcatcactcctgcatcagtgtggttgataagaaatgacaaactagaacatgtttggttaaatagaccatctgcctattcataatatggacattaattcttataaacagttacttcagctgtgtgaaatgcctgatttcctttcatgatatgctcatccctgggcaattacttctatttcacatgattttgtagtggaccatacaaacttgtttttcccagtgtagacgttaaataatttaatgggaaatgtatacggaaaatgtatgttaaataatatgtatgtgaaaatatttcaacaaggttactctggtatgtgaattaagaaacttttcttgatgaagtaaaacataaggttcagaagagtgtgaatctgtgaacaagcctaaacctcaaaacatgaagcagtataattttaatagttgtaaatacagtggtagcagaccccactgagatttgctgtgtattctgtatgcaatattaaacccagagatgctttttattttactttaagttctgggatacacatgcaggacatgcagttttggtacatagataaatgtgtgccctggtggtttgctgcacctatcaagccatcacctaggtattaagcctggcatacattagctatttttcctgatgctctcctccttgtcctcctgcaacaagtccccatgtgtgttgttcctgacctgaaaatccttgtgtccatgtgttctcattgttcagctcccccttataagtgagaacaggcagtgtttggttttttgttcctgtgttagtttgctgaggatagtggcgtccagctccatccatgttcctgcaaaggacatgatctcgttcctttttatgggtgcgtagtattccatggtgtatacgtaccacattttctttatccagtctgtcattgatgggcatttaggttgattccatgtctttgctattgtgaatagtgctgcagtaaacatacatatgcatgtatctttataacagaatgatttatattcctttaaacccagacattctgttttcttttttttgaaacggagtctcactctgtcgcctaggctggggtgcaatggtgctatctcggctcactgtaacttctgcctcctgggttcaagcagttctcccgcttcagcctcccatgtagctgagactacaggcacccatcatgcctggctacgtctgtaatcccagcactttgagaggccgaggcgggcagatcacctgaggtcaggagttcaagtctagagattcttatagcatcctttagccaaaattcattcggaattctggatcttttggggtcttagaaaagtaatgtcgtggccgtattgtctgttacacagcaaagttaagtctgaggccatacctggcaattaaacatgttaacatttcttccataaaactcatgaatattcaaacttatggagataaagaggataagtcagtacaggttaagttttgtcaccaaatatattttcttcattctgtttttattgctttctgctttctgggttttaggatacatataagagattgtggacctgtaaaagaatcccaaaggaattttggaaaattttcaagtccagcctatgatatttaggccaagaaatggcaaatatgtctagaaataatagctaccacaaccaaaatatataggtttcttttttgttttccatacactaagactacaggtggcttggttgacagtgttacttttaaataagatgagacaatgaataaatgaaggagtgaatgaatgtcagggtgaagaaacagtctcagggtctcataaataatgcccttcccttcctcgtgtcttggctgctttagcctcaggatatgtgagtctggggtcgtcggaagcctggatcctcctccagccatactgcaactgtctatcaaaatgacttcccaaaagttttccaacaactgagtcatggaggaagagctttaagaactaaaacaaataaagctcattccttccccaaggcctttgtaattattcttctctctgaccagaacgttttcccccatggctgattccttatcatcttttggatctcaggccaaatgcaacgcccaggggaacctgccctatccacccagcctctatgcccttactctgctgtgtgtcctcatcaccctctgaaattcttgtgttcactcccttttgatcggaatccttcactagcaggggtgctctattagggcagagcctttttgttccgagatgagtctcttaggacctggggcagtgacgggcagacagcactcagtaagtatgtattgggtgaataaataagtgaaggaatgtttccctgactgtcggtgctcagtgaagagctgacctgtgcctacggactgaatcatcttttcatttgtaacttttaactattgtaattctagataatggtgatgactgtattgtgaaaattattaaaagttttataaaaatacaaacacaagtaccttttctccctctcttttttaattcagttacctaccgcggtgactcattcatactaacatctgagtctgtgtcagaaacaagcaagagaaaacagaggcagagataaaggactgatattataatttttgaacagctctttcttctagataaatgttctttatataaaaaataaaatctccccaagaatattcttagactttaaaaatctttatgtgtgtgtgtgtgtgtgtgtgtgtgtgtgtgtgtgtgtgtatttttttttttctttttttgagacggcgtctcgctgtgtctcccaggctggagtgcaatggcacgatctcgactcactgtaacctccgcctcctgagttcaagtgattctcctgtcttagcctcccgagtagctgggattacaggcgcctgccaccatatctgcctaattttttgtatttttagtaaagatgaggtttcaccatgttggccaggctggtcttgaattattgacctcaaatgatctgcctgcctcaccctcccaaaagtactgggattacaggcatgagccaccgcgcccggccaaaaatcttgcttatagtcccttacaatattgaaactattgcttctgctcctttcattgcttaatttattgaattctttccattattagtaaaatatattttgtttctaaaagctggcaagaaacttactaaaatactacagtctaacatttagcatgctgcaaaaactttgacattgtcatacaaataagtggattcttcaagagttcaggttatcttgcaggaaaaagatgatttagttttatagagtttccttcttgaaagaggtctagttagaaaagatttcaaaccaaataggggcggagacagggtagggagaaaataccactatggatacttcaaatgaaataagaaggaaggacaataatatctaatatttgttgcttatagtaatactgtatcccaaataatcgcaaaaaaagctttactggaaaaaaatcattacacctatctgattataaagaagaaacaaaaattgattagtagtttgctattttcaaagtgtaaaaatagggtaattaatgctagatcatttgacactttggttttctaaaattaaacttctcagagaaatagattcaggaagaaatttcacaaaacaacattaattaaaatggctgggaaaaaaacaatactgtaataacagttgtagagtagtgaaactgggggaaagttaagcagcattttttgctttgctgatgactgcagtgggggaacttctatggggagaaaaagtggatattggctgttgccttaattaaactcatgatttatgaagaccctggttagccacagccacccggatatttcagagcgagagtcagagcctatttagtctgtcactgactctgagtttgggaaccataaataggcctgcttgtgttgggcttgtcttgtcatggacgtccactgagatcaacggaatgccagaagtgacccagcaagtaggagagagacacgttcctacgagagacacagaagagcgctccccacattctttaaatattttctcccggctatcatcataacctctgtcttatcgggattaatctttttctggctcactttgatcccagtcccctgttaggctcctcagatgctgaatacgttgtgaaactgtggtgtcaggattagagataaaaggggagatgtagaccatgtgtcatcagcatgctgatctcagagtgaaaatgcctgacttttcttcaagttatcttgcgtgcactttgagcatgtgggtgattaccatcagagcctggcaattctccctgcgagtcccggccctgcagcccacgagagcagggaaaggcaggatctagcagggtgttcctcatggtgccattccccatggacacagcctgggaggtcttctgtccacccagagagcctggagcagggagacagtaagggcctgggatggaatgcagctccagaggctgctgttttgcctgtttgtcataggattactgtattacagggctttgagaccagcctgctatgtcccctcagatctggcctctgaggcccctgggcaggatggcattttcactgcctctctttcccgctccactgaccttcactcagtatttcctccttctctgaagcccgcttctcatcaccacctacagcctcaaggatgcctgcttgcatctttgaggcttttgtcatcgggcttgaagatttttttccacatggtccccttaatctgctcccattcttgacagtttaacactcgtgctgaaatttcattccttgcagagttgggattttcatgtgaatcgttatagcttctctctggtttaccattggcttcccagagctcagcttctgggcacttaataaatgttcatttaatcaattactatcccaatactttgttctcttgtaacaacagttttcacctccatttctgacaatgctttcttctgattcattcaataatgagaggtcaacacacatgttctctgtttttctctaacaaaaaagacatgccttcatcccttcttctgttcagtggtgccccctctacctgggccctgtgtggcattcccctctgcttcctctggatccttggctccattaatttttttccacattctcctatcttcagtcgcttccttttccctttcttttttctttctttttttttttttttttgtgaggcggagtcttactctgttgctctgttgctatgctgcgatcttggctcactgcaacctccgcctctcaggttcaggcctcctgcctcagcctcctgagtagctgggactacaggcatgtgccaccatgcccagctaatttttgtatttttagtagagacgggttttcccatgttggtcaggctggtcttgaactcctgacctcgtgatccacctgcctcggcctcccaaagtgctgggattacaggcatgagccactgggcccggctttccttttccctttctttttccagacaggtaaaatgcacaaggcttgaccgttcttttaaaaacgcttctccactgaaatgactctccgtggtcacaaataacctctttattcctgaagccagtggacccttttcagttttgctctcatctgttttctccactgtcagccacatgccttttccaccaatttgccttctttttttttttcctctctctttttttttttttattttactttaagttctagggtacatgtgcacaaggtgcaggtttgttacatatatatacatgtgcacaaggtgcaggtttgttacatatatatacatgtgccatgttggtgtgctgcacccaataactcgtcatttacattaggtatatctcctaatgctatccctccccacttcccccaccccatgacaggccccggtgtgtaatgttccccttcctgtgtccaagtgttctcattgttcagttcccacctatgagtgagaacatgcggtgtttgtttttttttccttgcaatagtttgctgagaatgatggtttccagcttcatccacatccctacaaaggacatgaactcatccttttttatgactgcatagtattccatggtgtatatgtgccacattttcttaatccagtcaatttgccttcttaaaacttcttggtggcccagcacggtggctcatgcttataaccccagccctttgggaggctgaggtgggtgaattgcttgagcccaggagtttgagaccagcctgggcaacatggtgaaaacccgtctctacaaaaaatacaaaaattaacccgatgtggtggcacttgcctgtggttccagctacctgggagactgaggtgggagaatcacctgagcctgggaagtcgaggttgcattgagctgagattgcgccagtgcactccagcctgggtgacagactgaggccctgtctcaaacaataaaacttactggttttcctgcctgattgctttctctgaactgtaccctagatcttcctaccgtggtggttcagatgagagatgatggtagcctgtatgtgggtagtgcttatcagagatggaaataaaattgacaagagttgataatgtattagaagcggaggctaagagagaggtaagcaagataatcactaggtttctgacttgcataattgggcggtgatgtcattcactgagattagaagcattccagggcgactatgtggtagagaggctacaatgaattcaactttagatgtattggagatgtgtttagaatgtcttaagggtaaatgtcacataggcttttatttatttatttatttgagacagagtttcgctcttgtcgctcaggctggagtgcagttgggtgatcttggcgcattgagacttccacctcccgggttcaagcaattcccctgcctcagcctcctgagtagctgggattacaggcatgcaccaccacgcccagataatttttgtatttttagtagaggcggggtttcaccatgttggccaggctggtcatgatttcctgacctcaagtgatccgcccacctcggcctctcaaagtgctgtgattacaggcatgagccatcgcacctggccatgaaggcttttagatgggtctggagcttggaggagaagtctgaactaaggataaactaaaggtaagttgctgagtcatctgtagagaggtgggaattgagggcacggatgagacagcctagaagaaaaggaggagaagatgagaagagagtatcgaggtattggaaactggggagggcagacaagtctaaaaaggagactggaaaaaagtagttgaagatggagagggcaaatctgggcagtgttgggacacggaagctgaggaaaagagcagttcaagatgcttgaaatgaacacaccaaaaatactgtgaactattcagcacgtccttgttttataagtaaaattcatagtcacatcagcgaaataattttaaatgtatgtctgttgacttaaatattggttttcttttgtgactgaggttccagtacttaggaaaggaaatgaaagagaggcagggcactcagggctgactgtcttctcaaagtgctaactgatagactcttccaagaatggaatcatttgtgttttctttttttttttttttttttttttttgagacggaatctcgctctgtcgcccaggctggagtgcagtggcgtgacctcggctcactgcaagctccgcctcccgggttcacgccattctcctgcctcagcctcccgagtagctgggactacaggcgcccgccaccacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggcctcatttgtgttttctattaaaacatataacccagggtattagaccaccatggtggtcacggcgatcacaaaatatttttaactggtttgctgtgagctgatttagtgttctgaaattttattatcttgactggtagaattattggaaccagccatacatgttagagtgattgacagctacttctgatgaggcttttattggatctcaggcagcctgcaagtcactgtcctttgcattcagatgcatttatttccacagcctccagggtagctaatgttatttttccttcccattccgaaattttaagatgcctcagctttagcctggctcctaaactgatggacaagaggagaatatgaagaggaagacgggtctcctggaatcctcagttcccaggctcttccctccagtggtccaggaacacttttgtccctgtcatagatttgtgtaattctcatgatgtgtaacatatggaaagaaaaaccaagttttgtgtagcctaatagatagctgtttaggaaaccattccaactgtccagctttctgagagtttgcaaatatcactttacttcttacattaatagagcctcatgcaaatcaaatcatgttgaactttattagctatgcttgatgttatttatgttctaattaaattaatgagaatcttgcatttcttcacaaaattaaatttctagagtctctttttattgtaatgtctacattccataatcaatgaatgcttttaatcctctgcagtgatactttctagtgttttgggaatgaagcaaaggcttcagaaacattcaaaacaatcgagtgttaggctgtgctattgtttgtttaatgggcagaggtcacttgctatgggaatactgagggtctgcatgctggaatcattctctttttgcccaggatgggatcattgggtgagtttacttaatccatgggctttgtttcccaagactgtgtcagggaacaagacacaattgtttccagccccagagtcctcttgagagagtggctccagcaactttgctctgtctcatgtgatgtagcatcctccggcatcatttagaaaagtgaaagagcaagtagaaaggaatctatctgatcttcatttctttgctgttgttgttgatttgtgtcacacattgcttctcaggtggccccaagagtaaatcagaaattccaattgagattgcaaattttgttttaattctctgttgcttttccagcaatcagtgctttcctttaaattctgtctcgtctcctaaatgaaggcagcgtcgtggcccagtttgggtctctgtttagcaactgtggtctgtttgaactgaggcagtccacatgttacttccattctttagattaatgtgatgaccgtagtccctgccagaatcttttggaaccagttatcccaggatattgacatgtgacacggccataggactgaaaacttcctctcttccagggccagccacaggagagagaaagggattaagaggctactgttgtgtcaatgctgcaacttgctttaggactctgagctggtttcttaacttttccgttgatgagcaataaaaccagtagaacaataactgccttcagtgattttacagatttgtgttagttaataaatataggaatttagggaaagctgtttctgatttatatttgataccgatgtaacattttattggcgggcgctcctgctggatcctcactctgtggttaacagtgactccttttctggtagcactccctggctctgcaagtcacgggaaatagcgtaagagctcacttgtctcttatgttgaacaaacagaggcagcaaccgctatggcagagggtggcaccttctggctatgtgttttcctaagtggcctgaaatgaaactcctagaagttgtctcattgataaaatgaatgcaatctaggtaccactaattatctaaccccgggtcatcagcaggatttaccaccactgccagcagccccaaggcataggggaagaaagaattttttaaaaagaagtcatggaagcaacacagagagaaaaacaaagcagcgcttatgaatgagattcgctatgagcccccacccccgcccctcaggaataacattttagataagcagtggacacgaagcaggccccgctctgaaagagcacaggaggtagaaatgtcttccttttctaggatatagatggtgtgggtatcaaagccattgttgacaggaaggaggtggtgttggataagagactaaaaatagagccggagtagtagtttgaatccagcaaaccagccctccttctaaaattctgcagcacgatcccatcacgtaagaatgtgtctcgtccgtatgtgacaaagacacggttttattgaccttaaacaaatgggctatgtctgccagaaaagcttgtgccgtcttgactgtattcataagaaatagagagatatgaatcatgccatgtaggttccagggcgggggcgttccctccctctcgtccttcgctttgccttgcattattgcagacgacagcagtgcagggatgaactcactttctagggaggaagccgccagtaaataactaaacaaagaagataagttccgataatcatcgctgttaaactgagactaaaacgagagatgaggtagtgactgggagtggaggggaagttgattgaggtggatcacgagggatgcctctctgcggaggcgatgcccacatcgaagctctcaggatgagacggaaccagccgtgtgggcagctgtgggaggacgcagagatgggcaaatgtaaagatgcgaagaacaccagaaatggtgtttttgaaggacagaaaaatatgagtcgagctagaatctaatgagcaaagagaaacgagttagatgtgattttggaaagggaaggcaatgtgtttctctgtgtgctgatcagtcctgaggtgctgcagcaagaaattgacatatagaggtggataccagaatggtgaggagtttggaagaaaaaccctatgaagagcgcagtcggaactgggggttggttgtcttacgaagagaagactggagagagagccatgataaatgtctgattatttgagatgtgatctactggaagcattacacagatgatggttccatagagtggccctcagaccattgaaaggggccatggctaaggcagaactcacccgccttagaaggaagcactttaacccttgacctcatccatccaaaaatggaacgagcagcttcacaaagctgcgctgttagtttctagtcacaaagtgttgttaggcaaggacagctttaatttactagattttaagatttttcaggccagtgactttgttttctgtccatgttatatctctggcaagtacctgcgggtggatgctcagtcagtgtttactgaaatgacaaataagtaaatcgcagtagcaactggaccaaggatggctcaggcaacctctcagattatacctaattctaggattttataattctgtgatatgagtaaaagcagaattattttcaatacttaacaaaattttattgggaaaaataaagaactgtgaacattggtgagaagtcttaaaaataacttcccaaactctagcaaatgcaccctcaccctttccctgcaaagctccccacgcaaactcttctgtgtttcctaagccatgaagtacaatagtgccattgctgtttgtcagtgacatagaaaatattatttaactttatttaatgggggattttcagataatttggacttcaaatatgcagttttgaaagttgatctgaaatacatcacttataattgcctttaggcttttaagcaagcatatatgaaatacatttcattattttattcactatatttcagttaaaatttgcttttaaaatataaagtgcctgggtgcagcaaaccaccacggcacacgcatacctgtgtaacaaacctgcacgttctgcacatacatcccagaacttacagtataataaaaaaaattttaaataaaaataaagtgtcactaaaaaagtatatcaatagtcttagccttattgtcaaagaaaaaaaatggaaattcttagaccattttcatcattcagagtataaaaaatgttgacatgtactctattgtacagtgatcaaaggcattattgtacattctttaatttgaggtgattcttctaatgtgtagtaccaattattctgatctctgctgaaaagtgatgacatgtggtatttttgtttaacatagatctagtaagttgggtaatttaagtagatggttaaatatactcagtacctgaaataagcttgcgtatatgaagctttgatttatggaactggcggagattcagtcagtaacaatgtaattttaaaatagcatctgcattgagtggattacaaaggagaccacgattttccttcattcattcaacaaataattacatgcctactacgtgccagctcatatttgaaggcctgggataccacagtaaacctgacaaaaaccctgctgttaccgagttcctcataactaccaaagggttgcaaatgagatgtggaaagttctttataaccatatatatctacagagcactttatagtttacagagcacttccccaaacacctttaggcctctaaaacctatgaaaaaggtgcaatagtaatagcaataggacaataacataataaacatgtattgagtgtttactatgtgccagaccctcctctacaaactttatatgttttaacttgtgaattttcagaacaaccctgtgaggtgtatagttttattccgattttgcagatgaagaaattaagacacagacagattaaattccttggccagagctgcatagctaataagtggtagaggacatgctatcacccacaccaccagctgtggaaatgggagtcatgtggtcatgagttacctgggtcgcgcagccagatggaagtggaatttaggttttccgatttcagggccagtgcttttctgaatgcactgcagctgcctacctccaagcaatgacattgttaaaatgattagtaagcttttgctgagttaagctgtgataacaaataatccccaaatctatgacttacaacaaaggtctatttttttacatattttgtgagttatatgagttgatagtggctgtactccatgctgttttcgtactagaaggagaaactattatctcacatattctgctctcacagcaggaaaacacaatggtggaccatgcactggctcttaaaatcttctgctccatcgtagactgaaccgcttcctctcacatcttcttggccaaagcaaatcatacaacgaatggggtgggaaatgtacgtccccccacagtgagggcactaagtggtggtggtgggggttggggacctctgaggatgggtctgatagagaggggttgcaaatattttgagcaattgtgatgtttttatataaatattcttagttagtggtttttattttttatttatttagtttttttagagactaggttttgctgtgtcacccaggctggagtgcagtggttcagtcatagctgattgtagcctcacacgcctgagctcaagggatcctccacccagcctcccgagtagctgagactacaagtatgcaccactatgcctggctacttttttttaagagatggagtctcgctatgttgtctaggcttagtcagctgttaaaaatgatttgattgcaaacaactatgtggtctgcactgttctggtcatttttctttttcttttcttttttcttttttttttttttttgagacggagtcttgctctgtcgcccagactggagtgcagtggtgcgatctgggctcactgcaagctctgcctcctgggttcacgccattctcctgcctcagcctcccgagtagctgggaccacaggcgcccgccaccacgcccggctacttttttgtatttttagtagagacggggtttcactgtgttagccaggatggtctcgatctcctgacctcatgatccacccgccttagcctcccaaagtgctgggattacaggtgtgagccactgcgcctggcctgttctagttatttttcaactgttacatcttttgttttaatgcaccacttggccttattatccttatttggcagatgaggaaatggaatagaaagagaaacagaaaagttaagtaacttacctaaggtaacacaactcgtaaaggatagagtgagattttgaatgtaggttttcctttgccaaaccccagatttcccacttcagtgtactacatgttggagggaaatcgctaacgaatttggttcatgtttggacagatcagtgacttttttgtaaagccaaagaattcttacgtgtgaatgatttccagctagtagagaaaaacctaaactatctataacctccaggaaattagtcattctggctaaccgcatttttccaggttaatgaagatttaatattttaaaaataagcatttttatatttctgttgactaaaaacattcacactgtagaaattctcacgtagtgcatagaatattaaacatgcaatggtgaattgataaggtctcccgcaccaactgtcacctgattccagctggaagcttatttaatggtgcggcatttcagatggataagaatttgttatgcaaacaagggtttgttcacatttgattttcttaactatctaaaggctctaaacagtgagagatttgcccagagacaagagcctttcccaccaatcagcagagcctctcagtgttccagagtcccaaagacatcttcatttgaagggttcggggccttaattaaaggactgcattttgaggtctggatttccaggttatcaattttgggaactgaaaaaaacctttccacttagaaagtcatcatgggggctgggcacagtggctcatgcctgtaattccagcactttgggaggcagaagcaggaggattgggtgaggccacgagttccagaccagcctgggcaacatagcgagaccctgtctctacaaaaataaaaaattatccaggcattgtggcatgtgcccgtagtcctggctacgtgggggactgaagtgggaggatcactcgagcccaggtggtccaggttgcggtgagccatgatcacaccactgaactccagcctgggtgacacagcgagaccctgtctcaaaacaaaacaaaagcgatgatgggaagttgtcttttactgttaaaatggaaaagtgtgggagaaaattaaattacggctatgctttttcatactaggtgggccttctttcccagtatagagtcacccttttacaactctgaacttaagatataaaatgagatggtcgattgtttagtaatcactagaattctattccctcctcgaggtgtaagtgctgtcttcttaaatgggagaaatctgtttaagtttcatgatacatgctgacactgtgtatcttacaagtaaagatgctctctccaactttgggttaaaacatgcacagaacataaaattcttggtgactgtaaatgagatctatccattacagtgggttactttattcatttcaatatgttactttgaatacctgcatttgaattaaatgagattgctggcaggtgctgtggctcatgcccgttaccccagcactttgggaggctgaggtgggcagatcacctgaggtcaggagttggagaccagcctggccaacatggtgaaaccccatctctacgaaaaatacaaaaacttgctgggtgtggtggtacatgcctgtagtcccagctactcgggaggctgagccaggagaattgcttgaacccaagaggtggaggttgcagtgagtcaagattacgccactgcactccagcctcggcaacagagtgagactccatctcaaaaaaaaaaaacaacaaaaaaatgtggttgctgagaatgtcacacgtccagaccagtcaattgctcttaattatttaagtatacacacgactttctttcattatgctccttatgagtcaaacaaatatggagtgcaaagcttttaagacctctaaaatctctccatcagttgtatgctgctgtgagagtagaaattgctttcatggagatttgaaagggaaaaaaatttaaataacgatgtgatttagtgtgcagttggcaaatcagcatacttaaaatacatgaatattaaaataaagaatgcaataaacataactactgacttacaatttattgagcaactgacttttaaataagattttttccactcagactttcttcatagaccttcagagtccctcctattgttatttttttccagatcactgttacgtagaggcttatcctactcacagaatttacctgcatatttaaatggcataattattataaaaaggctctgggatacctttgggctcagtactttagctgagaaattttatacataaaatgacacctggctaataaaaggaagcaaatcggcatttattcagtgtccgttaagtgccaggagcttcaccgtgtgtctcatttaatcacattgcaacagtcacaacagtcctttcaatttggagcagtagttgctcttagttcggcagacaaagaaacccagcttcatgtaggtgaagaatcggcccaaagtcacagaatttgtagagcaaggatctggacccaggcctctctgtatcaaaggccttggctatattttcccatgaactctgccggcagacacgaaactacctctgaaaggagaaagaaaatgatttttttatttgtttgttttaaacaatagaggctttatctctcttgtgtcacattttactttagggtttaacacaagtctgtgaacatccagaaacactggcttcatgttgctccatcatccccagtaagaattataccaagaggccgggtgtggtggctcacacctgtaattctagcactttgggaggccgaggtgggtgggtcacctgaggtcaggagtttgagaccagcctggccaacatggtgaaaccatatctctactaaaaatacaaagagttatccgggtgtagtggcacgtgcctgtaatcccagctacttgggaggctgaagcaggagaatcacttgcacccaggaggcaaaggttgtagtgagctgagatcgcaccactgcactccagcctgggcgacaagagcaaaactctgtccccccagaaaaataacagaagatttatacaaagaaatttatgggattatatgaaattttccaggcttcaggctgaatagaccacttttatatggaaggcatacttcagatatcttagataaatgttttctttgataaaaaaaattttgagcttctccttgtaatatttgtttttcttaaattgcctctccttcctccacacaatcattagcctctgaaaaataaagatatattatctttttaaattgaagcaaacttttatcttttaagattaattgacattatctaatctattttgtttaaacgaagttcatacttacaagagggattgaaagtgaagtgacatttgcctctaaatcgagatagcagatgttgcaaacccagtaaatgccttaaaaaaaatacagtttacagcaaaaagtaaactctgaaagaaaacactgcaatcaaaataacgatacacttgatcagctttaaaactgatgtatacattttgtatattttatgtttgcctttagtcagtctacatttccttgtatctttcacccattctttttaattctaatctttttcctacagaaaaggatgttttaattattatattgaagtggacattagtttcttgatgccaaatcgtgttctgtctggtggagcgtattttctcaagggagaaaaattcaaaacctaatgcccctatgtgaaatctacatgtgcagtgtaaaacaaaggatcacgcaggctggataaagacaatggaagactttgggtggcttcttacagttctctaaggacccatgagccgttccatcttcagccgttccacccacattctctcccttttttgaggactttttctctctctctttttttttttgtagttattgaagctttaaaacatgatagaaaagaaattctcatttaaaacattttaaaagagaataagataaaaatatttcacaaaaatatcagtcgactcatgaaaatgaattgggaagtcattcttccggtatttagcattgttcaagtatggcttcctcgaaaaagactggagtattttatattctttcaggtctttaaaagcagcagaaggctttggttaacagagcagaatttcccttatttaggtaaatgttacactgaaagtagtaatccttttgaaatgctaattttttcatttaaacctagtaagctggaggaatttgaacgtgtgtgagaagtcttttatttctttggtcataacctattattttcttgaacttttggatggcagttatcatattgtgtgatatgtcctcagtttcagatttccggagacatgtaatgaaaacaatacaatcaacagtgaagataatatatcaaatatatcagtgcccattgcactgatggaataagagctaggctgttacagtcagcaaaaaacaaaaaacaaaaaacccaaaccagtgagctaagcactctgggttttggtgttgtgtttacgaaccatgtgtgtatatttaaatatgtctggggaaatagtttgtctctaaggcaattcaatcagtactcatttaacgaaagactggtactttcggaaaatatcttaaatttcagtgcagcacaaaggagccagtttctaccctaaattttcaggagttgtatatgatttaaattttagagcttaatttttgtgtcatttggcaaggatgacagccctgtgggaccctgttgcctttccccttgcacatgttagacagatctgtatctcttttatcggagaagccttctaacacagttttgagtctataggagttctgtaagcgcatcatgataatgtacccccaaagcacaaactttgtaaacatttttaaacacgtaatggatgagatcattaactgttttaggaagaaagctgatcagcaatggaagaaaagaggttcttattgtaaggtaactaacctaggacccgctgtctcgttcactcccctagcattgtattgccaaagaagttaaaatcaacacttacagaggattatggtatattatgcttttcagtagagattccaagactccagaatggcttgtgtttcatgcaagcatctttagcaactacctgatggccagcagtccagctagatctgagtcagagatcattgtggcaccgtgtggtgactcctggagatggcagtgtgtgtgtccctgggatgaccaacagcagccagagagattttttcctgggaggtcacacagcctgccagaattgggcttatgtgtatggggagaggatgggttcagagaattagagtgatcaagactagttctttcacagtcagtcctaaaaatttgcatccttcattgttaacatttttttttcctgaatgagaagactgaagtactgaaaagttatattctaaaaatgttggatatattcaacccttcactacaccacgtcttaactctcacatccccttaaatccttcatgcattctttctttgctgttctttgtacatcgttctgttattcaacttgctccattcaaagccctgcattcctgtttctgcaatcccattaagggcgtattgcacactctgggactctgccaagggccctgcccactcttcactgtctcttggatgtacgtataggttccaaccgttgcaaaatgatgatgttcttcacttctaggctttctcgaggttattctgataattctaaattatttcgaccctaaagttataagaataaaatgtgcaggataattgtctttttcccctttggacatagctataaagaagaatagatgaaatttgaatcgattatgggctccatctcagcctgtcttcattgtggggctagttccacataaggtgtgagtggcagatgatatactaatcaggaacaatttagtaacttaaagactttcttctgaactgacaaaattgccccatcttagaataaaggtcataaccatcccactgactatatatataagcagttaatttttttgagtgtacatttgctgctatatcctacagataaaactgtaaactgaaaatgcattcatctgccttttaagatcctaaaactctcaaaatatgtgtatatagtccgtgaagaatctcaatacgagtttcaggagttggtcaagtcatcccctgtaactttgcttttctccttttatcttgtaaagtagccttacgtctttgatccactcgtccaaaaaaagatcatagcattgcagttatggattttatttcagatgtttatttaaattttttaatgaattttgatattcttgttactatatagaacaagattttagctgtgttggagcatttccacttgtaatatagcccaatataatgccaaattaaatggaaatagttgtaggccaaattctgttggattattatttttagcttactcttttcttctttcaaacactgctttaaaaataattattaaaaaaaaaaacggtacccggagtgccattattttcttctctcagcttcacacagagctccctcagggtagaattggtgtcaaaaaaaaggtagtgaatatattcaaggtttacttgcagtttgcagctgccatagggtgtaatggttattatatttggcagcagttctccaacttgagcttgcagcagaatcactggaaggggctggttaagggcactggatcccatcttagactctaatttcatagatctggggtggggctccagaatttgcatttctaacaagttcttaggcgatgttgatgttgatgctgacagactgagaccacccattgagaacctctgcttaatggtaatgtctgcattcacgtgtaacagatatacatatgtgtgtgtgtttgtgtgtgttatatacacataggtattttttgcaagttacgcagtggtgccctccaaggcccacctatggatctgattgtgactgtcctccaaaccttagaggacgctggataatgactctttggaatgggtcatggcgttactgtctctaaaacaattaggcggttgggaaaaaagcaaaataatgaaagtgaattaagagaacagagtatttgaggtgacagaagtgtgagcatctagaggacttggtatattatgtatcaacactgcccaaggatgcatttctgtggctttaactaacttgcagaaacctgaggcaagttgtggttagtgaaggaaagggaccggaatcgccaagaacaaaaggagccatgggattacctgggggtgttatgtaagagcagccctttgagatgggtattaccaccctcattttactgaagagaaatgtcgattcagagaaagtacagaacttgcacaaggtcataaagccattatataatagaattgagattcaaacctcttcatctggtccccatacaatgctacatctagtggaaaaagaacaagaatttgccatttatatcatactgccttcccccatccaccaataaatcttattgctaactattttgttgtttttactctgttagcaacatcttaatgtatcctgattgaaaaatattctcagaattcaggagtatatagtataaatgtataaagaataaatgtaaattgtgtatgtgtgtatatatgtagatatatacacacataaaatatatagtgtagaaaataaatacgtaaagtatatagaatcatgtatatagcatatacttccagtcctttttatgcatttacaaacatgcatgtgtattttttattctaaattaaatcctactatatctatttttctcaattctgagcttattactgaatttagtggtaaacaaatttaatggtaaacaggttgtttgctaaacctcaccaaacaatttatatgaactgcttttaacaatttataatgacttcattagacaattaataacttatatccaaagagaatactcagggagaaaagcagacttatttttctgtcttacactctgtaaaaagaacaatgtcagtacatacaaacgctcattgcatttttcatttaggcattcaatgaccacctactttaaattgcttagtgtttgcaagaaagccattttccctctcaaaaaaaaaatacagcaaagaagaaactggccaagggctaatttgcaattcaaagaacaggtattgttatgtaagaagtcagaataagatattttcattgctttccgagtttcaccttgtgttacttgtatgtgctatagcctttagtcccacaatgtaaaaagcaaatcttttgagttttacaaccatcttacaaaatcatttttgtaagagaccatgcagcgactacctattaaactaatgtcaggagtttagagtagtagcctgacaaagaaactcactcctctcctcttctcatccagcattggttacataaacatcagtctgagaaggacaaagctttggttgtttggaaatggctccagaaactcgacatttaaacacttccatttgtactgaaaactctggctatttttggagtgctgtgctttggttggttttgcatttgttttggagaataacaaatatatttaaaatgttttagtaattagagaaggcagatacctttgtctataaagccagttatgttttccacatttcagtggcaccccaagctaaaagatggtgaaggtgtatttgagaagaataaaggtaggtaacagagtggagagctgtctgtaaagggtatgtttgttataattctggatatcctggctgttggctaaggtaagcagatctgactgtgttacttagctttccacagataatttatggaacacctcagggaacagctttcatattttacaagttatttttatgaatattctaagaaagtcctttattatgtatttatttatttagatacagggtcttgctctgtcatccaggctggagtgtagtggtgcaaacatgggttactgcagcctcaacctctgggcttcagcgattctcccacctcagcctcccacgtagctgggaccacaggtgcgcgccaccacacctggctaatttttaaatttttttgtagagacagggtctgcctttgttgcccaggctggtcttgaactcctagactcaagcaagcattctgcctctgcctcccaaagtgctgggaacaggtgtaagccaccacactcagcctattttttaacattttttttattgatatgtaacagatgtacatattctggggatacatctgatgacttaatacaaatcatataatttgtaaagatcaaattagtataactgggatatccatcaccttaaatagttgtcttttctttatgctggaaatattgaaattcttttgtagttattttgaaatacacaatagattactgtaaactatagttaccctactgatccgtgaaacactaggtcttattttttctatcaaactgtatatttgtacccacttatcatcctctcttcatcttcccctcacccccctactcttcttggtttctggtgagatctgcttttttagccccctgcatatgagagagaatgtggagcatcgtctgtctgtgcctggcttatttcacgtaacgtaatgtcctccagttccatccatgttgctgcaaatgaccggatttcactaatttttatgactgagtaatattccattgtgtgtatggactaaattttctttatccattcatctgttgatggacacttagggcgatttcatatcttggctatagtgaatagatctgggataaacatgggagcacagatctctcttcaatatactgacttcctttcttgtgggtagatacccagtagtggaattgctcgatcatatggtagttctgtttttagttcttttgaggaacctccatatagttttccatagtggctatactaatttgtattcccaccaacagtgtatgaaggttctcctaagaaagccatttttaagtgttcctttttcctactgtgttaactagtaatatgaaaaagaacaaaaaaagtgtatcaaaattagcaactccacatagccaacttaataataacctactgtagtaaatttattacctactaaataatacttagatataataagaattatacagttggggacagtctgtaataacagtttttttatacttctgtttttgataatttatccccaattctgaaatggttctattaaagaaagcccagatttttcaagtaaaggttgtttcttattcatatggtactttctgtataagtgtagctttcactgacaaatagatgagttattcttacatgttatctacaatgtagaaaatcaaatcaacatactgaactcatataatactgacaactatgaaaaatcatcagttagtgaactgtaacagttatcccaatgccaggaaatagcaaataaaaagtatctagagcttaattcattattttctttcttttttttttctgagtcggagacttgccctgttgcccaggctggagtgcagaggcgtgatctcagctcactgcaacctctgcctcccgggttcagttgattctcctgcttcagcctcctgagtagctgggactacaggtgcgcaccagcacgcccagctaatttttgtatttttaatagagacggggtttcaccatgttggccaggatggtctcaatctcttgacctcatgatctgcctgcctcagtctcccaaagtgctggaattacaggcgtgagccaccgcgcctggcctaattcattcttttcaaaatagtcactcatccattcaacacatacttatttagcatgcactgaagttcgagacactgatttggacactcagtgttacaagcttgtgagttgtaattctaaaaggctgagtatttttaaaacaaaaccttccagagctccagcactaaaatgaacattgcccttcagagagttcaccttgggcagttatggctgttccggcatcgtgagggtgatgtctcccctgtggcagccaggtcaggggacacacaggaatgtgggctaattaatgtcagcaccccgtgtttgtccctcagtgttttgtcatacacgccttactgatgtgacttaacttcagacttttaggtgtttcaaataacaaatgcgcttttaaagaataatggcctctatctgacagaataagaaaagcaatagaatacaatattagctttgaagactacttgcaaaaatttgttccagcaaaggctttggtaagagcagcactatccaaatccaaatcggggcattccctaccaagaccactttgctgatgctcccgcttgcccagtcctaacgcaccaggatgttggctgaaacactggatcattgtcttacatgtgccattacatattacgtcgtctatgcagtcaaatcatgtggtataactttactgcatagacacacttcacacacctccaggtcactgtggatcgtgtaggcagccttccaacaagaccagagtaaaggctcatttgaaaacatccacagttgattttgaggatccccaaattgctgtcgtcacttaatcctttttctgaataaaaattaccaagatcatgagtcaccacctgatcttatgttggtatcaatgtttcctttgtaaagaaaggcaggaggcatgagcactctgtttccggatatggatgtgtgtgaagataaataaggaagaactgcatttttttacagcaattaagtgccatacctgatcatctcatagctacatggcatttgtaataaataaatgacacaactaaatgaaatttaaaagatgtaattagcaaattttattaaaatgtcacaagctatttacttgttctacaaacatgtcagaggtgttgtgaaccagagcaacaccgtcttgaataggagctgggcaaaatgaggctgaaacctactgggtgcattttcggacagtgaaggcattctaagttacaggatgggataggagattggcacaaaatacaggtcataaagaccttactgataaaacaggttgcagtaagggagccggccaaaacccaccaaaaccaagatggtgacgagagtgacctctggtcgtcctcactgctacactcccaccagcgccacgacaatttacaaatgccatggcaacgtcaggaagttatcccatggtctaaaaaggggaggcatgaataatccaccccttgtttagcatataatcaagaaataaccattaaaatgggcaaccagcagcccacggggctgctctcctgtccatggagtagccattcttttattcctttactttctttttttttttttttttttgagacggaatctcgcccaggctggaatgcagtggcctgatctcagctcactccaagctccgcctcccgggttcacgccattctcctgcttcagcctcccgagcagctgggactacaggcacccaccaccacgcccggctaattgtttgtatttttagtagagacggggtttcaccgtgttagccaggatggtctcgatctcctgacctcgtgatccgcctgcctcggcctccctcctttactttcttaataaacttgcttttactttgcactgtggactcgccctgaattctttcttgcgcgagatccaggaagcctctcttggggtctggatggggaccctttcctgtatcatatttctctgtcctgtaacataatgtctggcgaccgcgaagggactgtagtgcagaaaccctgagccgcggggtcaggggttgttgggggtcctataacgtcttgcgaaccacaaagagaagacccccgacccaaaggaaatagactgcagcactgattgggtgacagtggataagtggtgggttcctgggtaaataatgggattgggttagtggcccatcttaggggagctccccatgtcccttgatcctgccctcttaataaaaggcagaggcgcttgaccttgggttagaggcccaacttaggagggttagaggcccctgaatcttaattcagggggttagaggcccctctctataaagtccgcctctgctaagaacagctttggcactatgagatgttaactgctgttctctttggattcatctgcgttgcactctttattaatggctgtgggtaacgggattaggcatgtacaggattgagggacatgggcaattcccccccctaccttcacgacagcaccctcagccgcctaaacttttcagtgttcctgcaatggtaggtcttcctctggcctccctgagcatttcgccttgcccaccctgccacggacagtgctttttattcgctcctttccctttcttatctctctgttactcagggcaaccatgttgctcagagaccacgtgtcgaaactcttaagtcagaggttggattaaagatgacggggctcacccatctgggggcaaatttaagctttgccaatttgatattgggtgctaagcagagtggctaatgtctgtgttttatcacttgtattttgctctggccagaacgaaaaaaaaataattttcctttatgatgcggcttggcccccagggcgatggtgccgcaagccggatcactagggccgctcagggaaagggaacccagaagcctggcttgccggcaaagggtaagaattctttaccagtcagatttctggcttctctctctctctgtgcaaatggctaaatgaatgaaaaaaaatcagtgtttatctcttctgtaaagttttgattaatgcgaaaaagaattctaaggctagtcttaagctgctgtattttgagctatgaattcgtttttctgtgttgagggtacttcaggatgaaacgtgggcttggaacacctgcaagcccgcttttcaagacggcccagcaagctggttagtcgcaaacttggctgcaggtccgtgaaacaaacaaaagactggatgaagtctccacgttgttttatgtccttgggaactttacattttaaccacgtggcggtactttctcttggtctctgccttccagggaacaggaatttgagggttcatgtcatagttatctctaaaaatcttattaaatagttaaaagtctttgcaatctcaaaattaactactctagactccttctgggaaaaaagacagagactgtcctgtgctgtagctcagtagctaaggtttttgccctttcccagtggcggtccaggttcaattccctgcctagaaagtaagtcatttctcgtttgattatctgcatgaccttgtcttttctcttctccgtggactgttttaaattttcctttctctgagcatcttggaggttacctttggtaaagttcagaaactaaaaatattggccacttggcatggctaaagttgggtaataagaaatctgaaaggatttcttttttaaagagcactatggttaaaagtcagcttaattagaagtggataaacaagctataaatatatttaaaaggcctttatgtttttctcttcttggaacttgtttttctgaaaaatggtttttttttcttagtcgactgaattatttttctccattttttttttgtcttgtcactcttaatgcacacgagaggccctaagataacttctggtagcctgggactccttgagaaaaacagaggaggcaccacagactccgttttgggaaaaaacctctgttttcctcatgaaatcccaggaattaaaggcaggtagttccctctcaaaatcaaaggttctgttctgttttgcattgtgttatctgacgtttttgagttttgggggtatcagaaattacttagcattataagagagctttggtgtataataactaggtaggaaatatactttaagggatggctaatagtagtgatagagggatacttgactctttgcacacttggatcagagaagcatgttcttggctacctggaagataaggaaccatctccaccccacgctggagatgagactcccatgaaggataggctgatgacaaaatgggctgattggctttgggctgccttgcaatgaaatacagggtaggatcacagccctgtcttctcccgtagtgtttccctccttttgggaatccaggaatcagtgtaaaacagcacccttaattttggggatgtgtctttgccttcagctgcttatttgcttatttgctgcttatttggccctagaaatgcatgctggccctgttcctccaacggctccaccctgaagccagtcatccaactaaaaaatttaaaaactggcaaataaaacatcttacaactattgtaatcttctgcctttctgtgtagctatatatgtgttgtgtgtagtgctcatataaaagagctctagttaattggcttaaataaaaataagtgcttaaatcagatattttaaaagcaacataaaaactgtaatgccttttggttcatgtaactttagtaatctttgagaaataaaaacagctttaaaaattattgataaaataaaaacatttagtctaaattatgcaagtcaaatattaagtttgctaaatgctttaaggtcataaactgcctctttaacttttaaaaattgttcaattgacctaccttaaaatttacctaccttacctaccattagattctagttaaggcctggggacatgtggagttagccacgccccctagctgtgctggagagtcagctcttatctgcacttctgcccggtgtgtcctggatagactccacacctagtacgtaattaaaatctctaatttactatggttttcaccaaaaatagaagttgctaagagttaacattataacatgtaattaaaactgttaaagtaacaattttacctgcaaggtatgtaaagaaagtaaaatgtgtttttggtagaagattgtaagaagtcatgggaatgtggatttttttctgcctaaattaaaatgtcaaagaattgttaggtttaaacaagttgtagaaaacttctaaaaattaattgtaagagagtgtgtgtgaacatactggctaaagttaaaagggtattattcagtttttctgtaaattcaacattggaatagaagcacagcaggtttttcttaaagcattaatctgctctttcacaaaaaaagtaaagggttataaaaggtttataagaatcttaccttatggttaaacattacaaatgggtaaatatatctataaggttttattaaaaattgggtttaacatgaatagtacattaacataaaggtaaaatttggcatatttgatataaaaatcatacaggaagcattattaaatgtgaaatggtgttttgctttatttggagtctatttgcataaatgtattattggcatatgttccgaagttatgggaaactcctatcattctaatataatttagtgtatgttattaataattataattgttatgtaaaattttgtgtgccacagaagtaaccaaatttccttatcaattgtggctttaatagtggctgtcctaaaactttttatcatccacagacaattgttgtcttgttttaatcctctttagaaggtggtttataatcaactatagaactctagcaggtgttcttaaatgcaggttttctaataactctggagattgtaacatcaaactaaaggaaaaaactttcaaaactctcatagaaaactaaaatgttcataactatcaaacaaaagttaactacatggactaaactgatgaagtctaatctttttaactttgcttgaaatgttgctaatcctttgtttttcagagtcaagaaaacttttcttttgagttatttacagcttttaacagttgagtgtatgcctatgaacaaaatttaaggcatatttatttctctctacctaatttctccagaatttaggaactagttgtcagtattcttaacttatggcaatataattatttgcataggtacaataagaatctgttttcttttgtaacaggacacaattggaaaaagtgattattttgccaaggctttgactggaatagtgtgttttcctttaaggaattaaacttaatttttagagctgatacaagccccatagggaaccaacctcataccttgcctaaaacagtccctgtacagggtttctagcctgtggtaagtaaaaaaatgtcactttctaacaagtccagaagcctcaagttatcttgggacttcaagagaaaagaaatttacccaattcacagatattggagtgtgcaaacccatgactgggctcagctttaaaaaagtcttatctgaaattccttctgtggaacaaagttccatcaaagccaatttaaaaaaaaaaaaaaagcttatgtgaaaaataattatttcttgctacactttatacaagtaatcatcccaagtataataaagcaaatcagtcttaccatgatttgtctttaataaaaatgggaaaccagaaagagaaatattatgtttcaaaaactatggtacacttgttattagattctagtctcatcagttgtttttaagtttatttctgcaatctaggctaaccctgcttattcctgtgaaccaaccagtgatctctgactgttactcagaagagacaagagggatgggtaatgtagaaatctgatcagtattctcattctgggcgcattacaatcagctaacaaccccatgtcagcttagttccaatagttgcccagttcataaaaaagccttctaatttagtttacttgaaataactttacttattttactttcctcttgtggaatatattgctgatatactctttgtataggaatacaggacaaggaatacaggacaagcttactgaatgttttcttaaacacttattaatcttccagtatctccttttgttgaaactcaagagttataaataaaccttaccatacatgctttctgactgagctcctctctaccctaaatgtaaaagaccctcatacttaggcaaaaatatcattgcccctattcagcctaaaaacattacaaaagatgagtcttcgtccctctgcaacccttaaaatgaagggttctcttataaaagggaggggggaaatgtgtcagaggcttgtgaaccagagcaaccctatcttaaataggagctgggtaaaatgagtctaacctactgggctgcattcccagatggttaaggcattctaagtcacagaatgagataggagctcagcagaaaatacagatcataaagaccttactgataaaacagttttcagtaaaggagccggccaaaacccaccaaaaccaagatgatgacaagagtgacctctggttgtcctcattgctgtgctcccaccagcaccctgacagtttacaaatgccatgacaacatcaggaagttctgctatatggtctaaaaaggggaggcattaataatctacccctcatttagcatatcatcaagaaataaccataaaaatgggtaaacagcagccctcggggctgctctgtctatggagtagccattcttttattcctttactaagtaagtttgctgtcactttggactgtgaacttgccctgaattctttcttgtgtgagatccaagaactctctcttgggatctggatggggacccctttcctgtaacatatttctttgtcctgtgacaaagatgttgaatatattcaaactttgctctttaaaaaaaaatagtattcaaatgactcacaatattaatacagagctcttgaaatggacagttcggaaatgctagtttttgacaggtgtgggagattatccatccctttgacgtgggtgtaaatctatggcagagtttgtgttggtcttcaggggtgtttctgtgaggacagaatcagagcatggatgagcgaggcatgtcacagccccagccactaaaccctgaaagggattcagatgtctgcaggggcaagaaaggaaaaatcatagaggaaggagacattatagcaaaatgatttatttttcacaaaatatagatgtgagagtactggacagttggccaagggaaagttaaagacttggtgcccggaagtgactctctaaatgctgttgagtgtaggaattaagtagacgatcactgagagaagatgtcacccaagccaacaaggaatcagcccctccctgtacaggccccctcccctttatagatctaaaaatcggacaaactctggctgcctccctgcttgacttcctctccatctgaggttcaaaactaaggggactaatccttggaaagtaagattggagagaaccttgaggattatctaatccatatcctctttctaaggaaaagcacacccagttatcgtaattaagggaaaattgctgatgaaaaaaagccaaactctgtaaaagatttaaagaggtttattctgagccaatatgaatggccatggctcggggaacagtctcaagggagtcatgagaaagtgtacccaaggaggttggctcacagttttgttttatacattttagggagacaggggtaacaggcaaagacataaatcaacacacgtaaggtatacactggtttagcccagaaagttggggcatccagaagtggggataaggagcattgggggcttacagatcataggtggattcaaagattgtctaattggcaattggttgaaagagttaagctttgtctaagacttgaagtcaatggaaaaaattgcctgagttaagataaggggggttgtggaagcctaggttcttgttatgtagacgaagcctccgggtagcagccttcagagagaatagatggcaactgtctcttcagaccttagaaggtatcactcttagttaatctctcttagatcctaatcccagctgtattaatggaaattctctgtagatgctaattccccccatgaaagatggctttacaggttcatttaagaatatgccaaagaaatatatttgggggtaaaatattttgatttccttcaaggtctgctatctgtcatgtgatgctattccagactgaaggtggaatttggtatcttattgctacacaaagaatcttgtttcattagtcttatgatttctattttaacgttagtgctggtcaattttggctaaactccaaaggagaaggtataggaggcgtgtctgacctcccttccagtcttgatctggaattcagtttttcaggtttctccagggtccccttggctcagagtggcatctgttcagtctgttggaggcttaggattttatttttggtttacaaaataaagaaagaaagagcatgggggaccaagatagaaggacatctacagagacctaaggtacacactcaaaattctcactttcaggaaatgtttgtgtataacctgataggttaaattcatcaatgcttacagtctggaccctctaaagatggagaatctatagtcagaatattcttaattttttaatattcttagagctcacttcaaaactgcagtatctctgacgctactatgaaatccccctgaaaatcgcattatccctacattcagcccaagtcgtggatcctgggttgattgacactgtgtaaaaataagcgtcacacaagcactgataataggtagtattttgcattctgttgctttattttggttttggaacaaaatcaaatacctgccttctttaattcctgtggaacccgtgttctcttatctctggtcattttaaaactatagttcaggacatagaaattcctcctgctaagacaaccagagtcttgagggctcttagtgtttattataaccgatcctgtttctgtagaacaggattcaatctttgtaaccagctagttatcgccttacagcaggacttattcttctttcttgacagttcaaagcctaaccacccccttcctaagtgcggctgaaaagacctttccctgaaatttagtctttagggcatccattgatttagaaagaccctggttcagggtcagaagaattgcataggaaacaaaagctcttttttctcccccttgcaatcatcggtaaataaggccttcccgtccttccaccatgcataggtggaggcgcaggacatcaggaacaggtgggtccagttgtgcatttcaattcttgtcacagaagaaggggacatgtccttgaaaattattttgcctagttttcacctgagttaagaaggaggacactgggagagaaagaaacagtggggatttagagatgttttgatttctttgctatgtgtgatgcctttgtctcggaacctcaatcctataagcagtggcgatatttttacggggcttcccatcttcaataaattgtataacggtaattaattctcacagcatccatttgactaaagcgttattatccctgtattatagaggagaaaactgatttgccaaaccccacaaagaaagtcaatgtcgaagaaaggattattgcgcaggagggtctaaaagtctaatctcagctctgagatgcttcttattgttaattttttctgtgagagcaggtgcagcagggatttgccaggtgacttcacggagggtgtgtgaacaggcggcagctctgcccttgcgcagtcctcgtgaccgttcggccagtttaagctgattagatgtggtttgtctccacacagctctcaacagagatataaaaatatagggtgaattattgtatagtgaacataacccaaaattttggtccacccatttccacctacatgagttcgaggtatagatgtcttatttattgagtcgacgtatttttgcaaaggttccgtagactgaaatatttagtttgcattcttttccataataacgacttacttaactataggtcattaatctcaatcctccacactgtaattcagccaagaattagtaagcaagcaaaataaatgtcccagcagtctcaaatatttcccacattcctctaaagtaacaacgcattgctctttggaaaaaccacctagagttgatttactacaggtttagatatggtgatgacagacttgctggagattcaccagataaagaaacaaatgaaatgagacgagagcaaatcttccgagaggccagcctgcagaaacgccaagctgaccctctgagaacaagggcagaaacagaactacgacacatacataagaactcacaaactttgtcaagcttaggccactggtttcccgcagaggcaagctgttgaattactacagggaagtccttcatgccaacacgacactcaagtaatggttactagtcataatgataaaactgaatattatttatttgttgaacgtttatggagcttctggggctctgacggtgaagaagacagacatggtccctaccctcatggagtttataatctagagaagagaaaagtcagtgtgcaagaacatacattactgcaatgatttcagcttgggataggtgctgtgagtgacatgaatgaagcaccatgagagagaatggctgagtgagatggtttccttcaggtgcaggggttgggagcatcagagactcgtaggtacctgcggtatgagtcctgcaggatctggaagggttttaaactggggagtgacaaggtttgatttaagtttgtaaaagacagttgattgtgagttagtcttgagggttgaggagaggagcgtaaccaggtggtcagtgaagatggttgtaactgggatgaatatggagaagatgatatggtttaatatcctctggtggaaacagaccaatcttccagacataatcataacaaaataactaacactgtttgaacacaggttaggtgctgggcactatgccctctcagtcgatcccccgacagccctgggagagggaggtgctgtcaagcacagctctgaagaggttaagacgtttgcctgcgatttcactacttatacatgctatatagctggggtttaagctcagtggtttggctccagagttcacgttcttagacctgagataatttccagaagataagcattttgcattctccaattatacctgtcagatttttgaaagacagataattcacttgggggaattcaccccaagaagcctgattagggcgagctattctttactcttgtgagtgaatcagtaacatgataagaatacaagtccctgctttgttcctttttggccgaatatccttattctctcaaacatcttccaggaagctctcattgattgtaccgcatttcattgatacatgctgattgtaagaggaaaatatgtacattctgttagaaggcaggtgcaaaacaattaaagaaaaatcaggacaaaaacactccaagagcttggcctaccctattcagacttgaggagcaggccacattcaacacaaggcaatttccagcagtgaataccctgttttcctttgacaaagggacgtgtaaattgagaagtgtgaaggaatgccaattcggaaatttgagctttacaaaaatattttggtttaaatttaatgaaggagctttgtattctaaagattaaagcatggaaatagttatctttcgaggaaggatgtttctcctattaatgctttaaataagaatagcatcttctcaagtatacatacaggtgttctttctccctacaatggacctgttagagcaagagaaagaatcagcaacaatgtgaaagaaacatatagggacagtcttgctggaggccagaatgagtgagcagggcaaactgaaaaggaaatggaaagagacttcaaagaaagtagaaaatgctaacatcacggtagtagcatgagaagaaacttctaggggaagctgggctaagaaaatgtttgagctggtggataggtaattcacacaagctacacttggttttgtacattgtagtcttctacattttttatttagtgtcataaagaaagcattttgatcagggcaaggacggagaggcctcctaattcacaggaagccctccccagagaggagaaaggagatactcctgagatgacaggaatcccggcttccactgagccctaaggagcgatatagtgtttggcatggcaacaaaaagatgtccttggcagctttgtcaccttcagtgatgactgttcagaggcaaagtggagtgaggacgtgtttggatattgaaagaggtgagtgaggagggtgagtttgactggggtcgcatgttcgccgtgttctacctccatcacttgaaggaggcctgcttaaccgcagcatcctgggcgtggatgctgagtttctgaaatgtaaataagtgcagatacgtagaaagtctaccaaattaaagctgaggtcatttgactttgtatttgagctctgaaacttgcaagataatgattacttttagagtacatagacagaataccttgagattaaatggctatttctgagtttaagtccagtggtctctaatttatttgttggtttagtatttattattattattattttgagatggagtcttgctctgtcgcccaggctagggtacagtggtgccatcttagctcactgcaacctctgcctcccgggttcaagctaatcctcccacctcggcctcccgcatagttcagattacaggcacgcaccaccacacctggctaatttttgtatttttagtagagatggggttccaccatgttggtcaggctggtctcgagctcttgacctcaagtgatccacctgtcttggcctcccagcgtgctgggattataggcttgagccaccgcacccagcagtattttttatttaattggagtgttgattagttggttagtttttattgtcgtctcgtgtaatggcagagtttcctcctgtgtgctggctctcctgaaccaggtgtgatggccatttttacacatcatccctgtttagcaggaaagaccataagaaacaggtgcaggacttgcccctgggcacgtatgagacatcacacttgcagcttgggagctcttcaagggcaagtagtgtgtcttattcttcacgttgttcctggcatctgttacactgtacttgctttcaccctcagatttgtggaaacattacttggctttctcaacaccaccacacaggcattccttaggcagattttgacagaacacctgcagtgtgacaagcagtgttctaggccctgggaataaagtggaaataaagatccttgttttcgtgaaactttggtattttgctggggtaatggagaagtgaacagataagataattttagagcatagtaagtactctttaaaaaaaaagaagagagatgttatggggcaggtgtggtggctcacacctgtgattccagtgctttgggaggccaaggcaggaggattgcttgaggccaggagtttgagaccagcctgggcagcatagcaagacccatttctccaaaaagttttagaaattaactgggcatggtgccgcatgcttgaagtgctagctactcaggagactgaggtgagaggatggaccacttgagcccaggagtttgaggttgcagtgagccatgatcatgccactgcactccagcctggcaacagagcaagacctgatctcttttaaaaaattatcagtcaatcaatcaaaaaaaatttttttaaggtgttatgtgttagaggaataagggagctgcttgacttggctggtcaagcacggcctctctcaggagtgaatttgcactgagacctgagtaatgagaagtctccagctgggcagggatttaaagagggggctggccaggcttaggcaccagagagcccacagatccaaaaagagagggtctttggtgtgatcctggaacagaaatatcagtaacattggagcagacacatcattttccacataagcacagagcatgagaggtttttgccctttacggtcaaaccagatgtctctcattgaccttttatcacgtgaaaagaatagaattcaagtcaacttaaacggttatcaggtaaccatacatgacatcatgttttagtgtttaaacgggcagaacactctttaggcctttcattcttctagccctcttgagataacatttgtgataaggtgttgaaaagagcataaggtttccatcaagcctttgactcgaatgcgaacctgtctccagaggacttgcggtgttacacttgtttaaatgccaagaatcagtaaacattattataaacaaattttcaataaaatcatcaaaggtcttttcccactgaacgtgaactaatcttggccatatttttaagcactgctgtccaattattttaaataatgtgcagcacttaactatgttatttgcctagaggaaataatgtttcagtgaaaattatcagctgaattttcttaggttatctgatttcctattgtttaccttctgcttattatctttcaaagtgacgtatttcatatatttcgtctgtatgtatatatagagctttccacttggcaaactttgatatctctctgctgggcataaagtctgctaagtaaaatgaaatgaactcagctctgtgttgtaaacactgaactcagctcagtcctgtaaacaggactaccttgtgaaacagaaagagctgtgttaattttactttcattaatatgaaggatagtatggaaagagcaagaagcatttataaaaggcctctttggcaatggcctttgatgtctacgtctgaacaaaatgtcctgatgtgaaaataaaatggcaatattaaaacagcttttctgtgaggtcaggtcctattacttgggaatgtttaaagaaaaagcataaaccaggcaataataggcttagaaattctgcagtgtggtcagaataagatggagtttggtggaattagtttatgttgagtatgcagtgccagattagatagcaatgttaaccaaatccacagatttttcctggggtgaaaatatctcatttcagagaaaccttatgttaggcaagtatgttcacagaggtagagttggggggtgggggttgttgtttttttaatttttttattgtcttcttttccatctgtttcagagaaaccaggtattttcaagcactctttaatatgaaactgttaaaaagcaaaattatacactacattttgggctgtgggttgctcaaaggtagatggaataataagcttcccattcagaacaaaggaatgttggttgctattattgtttatttttatagctactcttcactcataatagtagggcccttctggctgtgttgttaggctagacatctcctgggaacaagtgaattatctaagcagtacggcgttgccttatgaagggatgacaaaataggatagagtcccagttctctaccatatccaactactgaaggcaaaactgctcttgttgccagtaaaatcactacttttttctttattttaccaagtggtccagttctatcaataaatgctgctcagcaggcaattttaaattctaagcacctgaggaaatttttagaagaatccttttatttaaacagtagtgcaaaattacttagatatacttagataacatttacaactcagggagaggacaaggagttagctggtgggacccactccctaccgccctcaaccctgttacaggaatcctccatttcttggcctggatcctgtttgtttcttttgccattgatatttttccatgcagaccagaactgagaagtaattaactgccaataacaaacgtactagcagccaggcacggtggctcacgcctgtaatcccagcactttgggaggccaaggcaggcagagcacctgaggtcaggagttcaggaccagcctgaccaacatggaggaaccctgtctctaccaaaaatacaaaaattagttgggtgtggtggcgcatgcctgtaatcccagctactcgggaggctgaggcaggagaatagattgaacctgggaggtggaggttgcggtgagccgaggtctagtcattgcactccagcctgggcaacaagagcgaaattccatctcaaaaacaaaaaaaaagaaaaagaaaaaaaagaaatgtactagctgggtgagctgggcagcttaacctctttgagtttctgtttccttgtaaaatggaaatagtactaagaactatctgctggggctgctgagtgcatggtccataataaaccccaatcaacatcagctttggttggtatgatgatgaaggtgactatcataaaggaaatgagatgtgtctggaagtcacatatcctgggcctacctcaccactggcttatcacatgccctttcccagtgcctgaagtccccagtgtgcaaaaaaaaaaaaaaaaggaggtggaaatcagctccatccctctgtgacatttcgtgatttgattaatgaatgcctccagcgcatacagtggagctggcctgtcatcaatagagatgaaaattggtggagcactaactgtgtgcagcatggtgctagtgtaggtttggggataacaagagatttaagacaaaaccctatgtcatgcgctgcgggctccatgttttgtgctgaaacgaacagcacaggcagtaagtgccacagaagaggaggctctggacaagcccgagggctgccaagctctggaggctgcgcttgaagacaagagaagggattgcacaccaggtcggggcaggggccgctgcaaggatctggcacggacctaagagcagggaaggatctctcgcagcactgcacaaaccagcaattcgaagttgcttagctagcctatgaaaacccacatcagttactaaaatgactgccttcccttgagtgatccgcagtgtctttatttgctttagctctttcatcagagcaaggtatttggtttccttttttctgtgtgcgcttttaaaatattttgttgaatatgacagattatatatatgcatatatatgtgtgtattaatatatgtatatattaagaaagagatatattgcttataatatgattacttggaattattattatcatctttagtataaaatgtcgatcagtactcctcatagtctggaaatgcaatgaaatgcctgtattggacatacatgtagatgacattttgagtgcattgcctgttttcccacatgcaaggcagggccctgtgccttgagacaatttgatgaacaagccatcgttgaagtctggcctcaaagagctagcagtctataaagacagatactcgggtgtacataattattaaatatataaaagaaagtgggagcaggaaataaggatgtaggtcatgctcatgagccatttatatagtctgtgttttcttttattattatgattatcttttttagattcttctcttgttctgtcgttcatggagtatgctttctgcccatagtggatcgcagaatagtcattttctccatatgctttataatttttgctgtaaactcatctttggtcacatcccaggagctctgtggtgtccctgtagaatacttttgcatttgcctctgctgggccctaagggtttcataccagtttttatttaatatctcaatcaagagttcacaagcattgtaaaaatattgccttgaaacccacacgttgcagacacttcaggttctcctctttcaaaaagactttctccaccagtgacctgagcacctccatggccagataatggagccatgggtagaatttttcctgaacattttctcagagattggagtgtccttttcatcaccaggttcatgcagtgagaaaatccagcttccccagttcctggacccagtgtggacatcaaaactcctgtcctttaaatgaccattcagttggagacttcttttggccgctcgactttagtgaggcccctgctttaggctctcagtttcccccacggggtcttgctcccagaggttttccttttttgttttcaaggtgggccacataaattttttgattgcactctttgaaaaatgtgtattttattcaatatttctgtgtgttctacattttgggaggcagagacactgcttccaaccagtccatcatagtcactggaagttataatcactgagatttatatattcttgaataaggaggaaagaggaacattgacagtttatctcttactcacatagaatggaattcttttcaaccaaaattttagaatagataatttctatttttatggaaaatctattcttactaagtatgaacctgactcatggcataaaaatagaccttttcttctcctcttcctgttgcacatcagaagcctcatttcagtaaccagatcagcctctgagttggcgcggtacggaaaattgagtcccatccagacagacacctctgtgctgattacatctgtgccacaaacctggcgggtcaattggacttgccacttctctgggcatcatctacaaaaagggatctcttcaaaccttgttaagccaactttggaaatcttatgtaaaacagataagagtggagaggatctcttgaatgagagtgaaggttttgcctctttgccaagtagcctctaagttaccagcagcaaatcccctaaggagcctcgagaagcagagtttgtaaaccactagactagatacttctttcatgtctaaaatgacgtggttctgggagaacacagtagtaggcagcactactgattgtcagctgctcatctgtcgggtaatttctcctacaaactcctcctgttcccctttaataaagtaaaaaactcattgagtaagaggttgactccagtctccttcacatctttaagttgtaaagctatcatttttttctttaatagggattatccagccacactgggacatatggtcatcctatctttaatgattaagtgtgacagccttggtagaatttcctgcaatttagaaatatttaatactataatagcatgcattttgttagcatttgtctatgtaattgtcactttaataacagatatatttaaagatattcccataggttggacatgaatgagaaaataagacttccttttttccccaaagatcttttgggcattataaaccctctcactattacattaaatatagcccaacattgagaagaaaacaatactaccatagtctcttttcatgttgaaatttcagctcaaaggagcagaaaccaagttttttgttgttggtggtggtggtggtggttttttttgagacaaaggtcttgctatattgcccgggctggtcttgtactcctgggctcaaacaatcctcccacctcagactcctgggcagctaggactacaggcacacactaccacatctggctgtagaacccaaactacttaattataactcagatgtgccagatttctaacatgttatagtaatacatcatcattttatttatttatttattttatttattttcagacgaagtctcactgttgcccaggatggagaatagtggtgtgatctcagctcactgctacctccacctcctgggtttgagcgattctcctgcctcagcctccagagtagctggtattacagatgtgtaccaccatacccggctaattttggtatttttagtagagacagggtttcgccatgttggccaggctggtctcgaactcctgatctcaggtaatctgcccgcctcggcctcccaatgtgctgagattacaggcatgaaccaccatgcctggcccatcgtcattttaaaatttaattttaattggtagtgtggtaattattgtccagcaattaagtgtttattactgccagctgttaaaaaatcaacaagaaatatgtggtttaaagcaacatttagaaaatgctttataattcaaataccagtggaccttgatgaaaagtcaagaagtcttacaatgcagtgcccttcccataggcatgcccaaccccaaacattaggagggatgggcatcttcaaggtaattgccaagttatttcaaggacagtagtgaggatatggatagttatatcaagttctgtgatttcttcattatattagtatatgctttgtcatgtgctgtgttaaagaagcaaagataaaattttcattattttctatgtagagttttgcattattttcttcaagagtagtttcagtgtgttaatagcatgtaaatatgacaatcgaaagtggctgtcatcggtaagtgaaagtaagtgcggagtaccaatgtgcctttgcttgtctggaacctgaaatttttgttagaaaactagaaaagatactggatacaaatttatggttaaatgggccgggcacagtggctcacacctgtaatcccagcactttgggaggcctaggcagtcggatcacctgagctcaggagtttgagaccagcctagctaacatagtgaaaccccgtctctactaaaagtacaaaaactagctggatgtggtggcacgcgcctgtaatcccagctacttgggaggctgagtcaggagaattgcttgaacccaggagacaaaggttgtggtgagccaaaatcatgccactgcactccagcctgggtggcagagtgagactccatttcagaaaaaaaaaaaaaaaaaaaaaatttatagttaaatatctcctagtacatgcttatatcagtaatatattttatgaactattattttaaataaggactaaaatagaattacttccgctttaacagtctaccgacaatttctaacagtgaaaatactgcctggtatttggaaatattagaaagctgtggctttcctattttgatccacttggatacttaccgcatttttaaaaattgacttcaacgtaaataatagtaatctgctcctttttccttttaaacgtttatgtttaattgtgtaataattacatgaatccattcttataaaacgtaaataatatgataaaccatatctatttcataaacacttttcttcatgttaaattgactgaatttaagatggtggtaataaaaacgggggcctttgtttacccagatcatatgtcccttgctttttcgcaattatttttcactgttgtgtttcttctagagataccatttagtcattctgcatagtcccagatgagatgacattaaaaccaagaaggctgtgctgtgtgaacattcatcttttggatgaatggagatgtggtaggcctttatcaggccatccgactccacggtacactttctaggataaagatatatatgtaaatgtatctggttggctcccaagatggagtggcagagctcatctgtagagtttcctcctcagtccaggatggtctgtaatgagaagttgcatgagccaatttgagttctccaaaattaacaagaatgaataaaaagaagcgaatcctttgatactgcggtggatgtggtggggtgaaatactctctgagatttgccttgaaatacttcagaaaggaaagaaagaatgggcagatggggcagtcatttttgaatggaggtgatgggtatgtgggtgtttgttgtcttatttttcttcgatttctgacatttttcacaataaaaacatactgaggagttatttttaagcggtttaagaaatattaacccagagacgtagtccaaatgcgggtcttttgatggtgtttgtggagctgtggtctgggagagagaggtgcattacctcaacgctactttgtggtataatttttctgcctaaagaaagtgtttattatatggcttttaccttttaagaactttaaaaatattttccctttacaaagtctacgtttataagacatgagagagtttaattaaagtaaaaaaataataattgaacacttcaggttagggttttatttcagggttaccaaaacctgcctctctcctctgactggtatcactttcagatgaaaacgagtgcatgaaatcggagcattgccagactcccagtttcctttctactccaagattatatgttgcatgactctacgtttgcaagattttccagatgaccccagaggggcatattcacagatgttaatctcttataaagttattataattttggttttttaaaaatgtgggtaatatgtaacataccattaatatccaggcagtctggtattttaaatctatctgcggatcgtactggtcagcattataataaaaggtaactttgtggtgttttcagcgtattgaggtaaaatgaaggggaaatgttgaacctgtgtttattactgtggagagaatctgacactccactgcaccctgattattttgtataccctaagctaaatagactaacgctgttacgaagctgtcaggagaagcgtgtcagacactaggtgtatcatgcagtcagactggtgtcgcgttggaaaagccagtagttgggaagggaaaaaaaagtgaccttgtactctcaacattgtctttacactgagtagaacagatgagattgtgaattattcagaacaccgaaagcttataattgttagcagtggtggcggcgatagaggagagagacagggctgttttagtccaaatgtctgattctattaagcatcaaaggaatctttttcttaaaaccatctttgggaatttgggtggtgtggaccccatgaagaatccttccctctgtttgatacctttttgggaatctgggtcaaagaggcacaagttaatatttagcatatatatatatttggaaatgcagagtgaaagaacaaagacactctagggagaggatttgctgtttcagcaggtgacacagccacgcggttatcttccatatcagtattaagggttggtcttgggtttctactttccaacgctttgatgttattgcacttctcccttgtggtttaaatactacaggctttgggttaagcatggatggtatttgattgtgaattagatgaaaattcagtatacctaggttaattcttgtttgtaaatgtttgggcagtttggtgagcatgctagatagaatatggtataaggaattaacagtcatatcaatttgaaccataatgttttctgcgtctgtttcttagtctttgtttgttttgcaaagagctaagtgctccacatttacagtccacgtgtgtttatttagggtccactatgtgtctgctgatactgactgtggggtccacaactgaaactataagaccaggttcttgctcttaagttctcagctatctgggtagacgaaaccattttgaagcaacacatgaagacagatctgtatgacctacagattgcaagtcctctagaaggtgcatgaggaaactgctcattttaagccaaagttgtttggaaaggctgcaaaaagcatgtagcaacagagctgtttttggagcatgggaagaattggagaatgggaagatttgggaagtcaaaggcaaacgtcagaacttcagtggaagcgtggaattgtgaaggggatgtgtgcgtggagctaccagagaagcacagcctgtgttgtcagagagcagtgatgttttcagagatggaccaaggctggaccaaaaccactaaccataaaaagaaaaaaaaataagcctttaaacaacttgcagattaaaattgataaataataattacaatcgattaaaattgatgatgaaccactgatcatctttctgaagcagatgtcttttgggggagctacttcccagggctttgctgggcgtccccacagcacagtctcctgatacaggagatccatcgtggcttgaactgttcacgcagtaccccatcacaactattctggttggcagctggcctcacacctcttgcttctgggatcccctaaactgcagggcatgtttcttgctgggtattgccaagggtatgggcaagatagcttgagtccagctactttgcattacaacctggtgattcatgaagacagctgtgtctttgccacaaggaacagtggccatgcaggcagctccctgtttctgcctttctcttaaacctgccattctacaattttcttttcccttctcagataagcccagcatagatcagcaaattggcaggggcccacctaactgttcaaccagagattggaatgccgttctctacttcttgccagcatgcctgtctctatcagagcataccccttctttggttttcacttgagagggagaaagttctcaccacaaactgcatctccacaacgctgacggacccctcaacccccacatctcttccctctaccctccccagccctttctgtagatgcagaaggttgtgggtggtgactgttgggagcaggcctagctcttgacaagctttagagactgtttggtctcaattgttgacacttctcagaatgtggggctctcaatccttctttgtcctcagctttggtcccttgtggtaaattccaggtaatacgaaaaaaccccactctttttgccaactgaccaccaccccctctcaccaggactattaccgaagactctgaaatggtctctgtacttgcagtcttgccccctcctttctccctagcgtgtggtccactctacacttagcagccagagaagtcttttggaaacacatcagattacacaacagtccagacggaaactcttcagtgactgcccactgctgttaaaataaaatgcagaccaggcacggtggctgacatctgtaatcccagtgttttgggaggccaagggaggaggattgctgaggccaggagttcaagaccagcctgagtaacatagcgagaccccgtctctacaaaaaagtttaaaaattaactgggtgccgtggtgcatgactgtagttccagctactgaggaggctgaagtgggaggatcacttgggttcaggagttcaagactccagtgagccatgaccacaccactgcactccagcttgggtgacagagcgagactccgtctctaataaataaactaaaataaagtaaattcccaaatcgcccagtgtgatctggcccctgcctggttctctgtctccatcacactccactttcactcattccttaagcttcagcctcacaggctttttgttggtggctgtaatacaccgagcttttgctatttcagagaatgtgcatctgcagttccttccgcttgaaatgccctttcaccagaccctcatgtctgcttcttcgtttccgttcctaaggaatgaatccgtttgtcggttcaaacatcacttcctatgaaatgtttgtcctgaccagcctaggacaagtagttgtcctctcctcaacaatccctttatttcctagtacacttttctttctttacttttcatttattgtttatttatttattttttttgagactgagtctcgctctgacacccaggctggagtgcagtggcgcgatctcggctcattgcaagctccgcctcccaggttgacgccattctcctgcctcagcctcccgagtagctgggactacaggcgccctccaccacacccgtctaattttgttttcgtatttttagtaaagaggtggtttcaccatattggccaggctggtctcgaactcctgacctcgtgatccgcccacctcaccctcccaaagtgctgggattacaggcgtgaggtaccgtgcctggcatatttttgtttgtttgttttttgttttttgtgttttttgagatggagtttcactcttgttacccaggctggagtgcaatggcacgatctggggtcaccgcaacctctgcctcccgggttcaagcgattctcctgcctcagcctcctgagtagctgggattacaggcgtgcaccaccacaccggctaattttgtatttatagtagagacgagatttctccgtgttggtcaggctggtctcgaactcccgacctcaggtgatccaccctcctcggcctcccaaagtactgggattacaggcatgagccactgcggctggcctatttatttatttttaatagagacagggtctctctatgttgtcacattggtctccaactcctggattcaagcagtcctcctgcctcagcctcccaaggtgctgggattataggagtgagtgcccagcacctccttttcttttttattttccttgaagcccccatcccttctggaattatactccatcatttatcaacatgtttactagttttcacgtaagttcctctaggacaggaattttgtctatcttgttcctcactctacccagaatctaaaaatgtgtctggcacgtggtgggttttcaataaacagcggttgaatgagtggatggatagatttattcagcagttggctccaactactacgtggcaggcattgtgtcaaatgattacacagactaggtactgccatttccatgttttaggtgaagaagttgacttcagactggagtgacttctccaagctcatacagctgttcagtagaaaaaggaactgaaattagctgctgtggactctgactctagagaacaggctgttgctaccatcagcctggacgactcatggagcacagggtggaataccagagcgtacaaagtcattctctcaggtccaccacacctatgccgaaaaataaaataaataaaggtcgggggctggaaatgtgctaagcaatttaactggccaccgattttaaagattcatgcgagggccaggtgcagtggctcatgcctgtaatcccagcactttgggaggttgaggcaggaggatcgcttgaatccaggagatggagactagcctgggcaacacagcaagaccctgtcttggcaaaaaaaaaaatttaaaaattagcctggcatggtggtgcacacctgtagtcccagctactctggaggctgacgtggaaggatcacttgagcctggcaggcggaggcttcagtgagctgtgattgcgccaccgcactccagcctgggcgagggtgagatgctgtctctacaaaacatttaaaaagatttatattaaaacgcatttagatgttttgtttcatgatgtgtaatgaaacatttgtccagtttagataaaggacttactctatctacagcggcctgttcctggccccgctctctggatatgtcatcgccccctctgctgggtgtgcgagggcggagggtgagcagtgcagggccctgccctctgcctgcccaggaggccactggcactctgcagggacacatgtatacttgtcgcagttgtcctgtacacatgccccaacgtagcagcccagtttgatttatgttatccaataaatctttaactaaatcttattgagggaaacatttactgaaaagttaaagtttgagcttaggaaattaagatcatatacatattttgttcttttataagccaatgagatcaatttagaaagcaactccttcacctgctgagtctaataaacattaattgagaatcttgtatctgagtcttgtatctgaggcttagaggtgtatgaaaatgaagcaggcagaaccctggccttgtagaagttgaatttaatgggatgatttcattttccaatgtcttcagaataaaatccagactccctagcgtgttgaccaagttgcttcagtgtcgggttgcccgcggctccaccctagagatgacgctcaggaccccagggcaattccaccaacctgccttgccattctgcccctccctgtggatacctcattcctctgtctgggacccctccagccaagtcactcccgctcgtgccctacggtgctgtccaaggttcctctcctccaagaaggcctctctgccatgcccttcctcaccggggctaatcactctgtatgttagctgaccagccacttgctgtcttcctgtgtcgctgtggactaactggcggggcagtgtcttattctgtgtgtctccagatcagagtggggacctggcgtgtggtaagtgtgcgatgagtgctgtcgactgaatgagtgatgagtgaacgaatgaaccgtgagctggcactttacctacttcctccccgtactgctttcagggcagccccagaaacctggttccagctgcagaggcctggtttctgaatcctgaaactgagcagttgcttgtattttgcacgttcttgggacaactctgccaccaatttatctctacaatgcctagaaccattgctagatgtaatatggtcatcaaaccaaacttggcgactttaaaaaatggctttacgtccctaaaaagccttttaaataggaggttttgttttaatttgagacagtcttgctttgtcgcccaggcaggagtgcggtggcacaatctctgctcactgcaatctccatctcccgggttcaagacatcctcctgcctcagcctcccaagtagctgggactacaggcgcccgccaccacgcccagctaatttttttgtatttttagtagagacagggtttcaccatgttaaccaggatggtctcgatctcctgacctcgtgatccgcctgcctcggcctcccaaagtgctgggattacaggggtgagccaccgtgcccggccaaaaagccttttaaataggaggttttgttttaatttgagacagagtcttgctttgtcgcccaggcaggagtgcggtggcacaatctctgttcactgcaatctccatttcccgggttcaagacatcctcctgcctcagtctcctgagtagctgggattacaggcacgcaccaccacgcctggctaatttttgtatttttagtagagatggggtttcaccatgttggccaggctggtctcgaatgcctgacctcaagtgatcctcccaccttggcctcctaaagtgctgggattacgagtgtgagccaccatgcctggccaaagaggagtttaattccacagactctcagattgatcagtaagtgatatgaagcaagtgcaggatccctgtgctgatccaaggagtgtgccccgagctggctggtctccggcaggcttcccacggaggacaggaacctgagcctgtgtgtccatggccccatttgtccctgaccccaggttgttttacaaagctgcttgaaagagggtctccaaaggccacttagaggccaggagacaaagcatgaaagagcctggtatgtggggatgtggagtcattgtgatagagcaggacagagatgcaattccaggagatcataggaaataaggcgcacacatcagaaggaagtgtagatttcagttgtgaggatgccccgctgtgtgtcccacgcagcgctggatgcctgtacctcgtcacatcagtgaatcctcacagcctcctgtgagactggataatattaccctccccatggtacagctgaggaagcagcctcagagacgttatgtgatgtgcttcaggtcacacagctaattaattgtcagagccatcacagaaacgaaagccagcttgacttccgagtatgcatgcgtccctcctcatggtgtcttctccaaggatgtgatggatacacacagacccagaagctgaggagcagagcacgggctgcagagacacccacacaggacagcccagtggggtcgcgttcccatggcatattgtctccaggcgctctagggtcttaaactcagctgtgtgtgtagggctgggagggaggcaggcagactccaaccatgttatgtgcgtcacatttctattattcagccctagaatggttttctttgtaatcttattaaaacttggacgtcttagataaggacccataaaaaagttttccccaaaacatttttatgctcgtcttttttcctttttcagcccatgaaaaagctgtttttgccatatgagtgccttctgttgtttatggaacaaactgcaaggctaaagaacaatttggcactgctatatttcttttaatgagaaaaatatgatgctataaagatttattgtaaaaaaatgtaggatattagaaggtgggcatattgatacctgcaactaaacatagagaaaaacaaaaacagagccatctcagaggccccatgattggggtgatgttatttcatggtattccacccttacacacatttgggaatattttctatgtaaaattcacctcaaaaaaatgaacagtgcctatcttggtaatagattgcttgtctcacagagttagatttttgtcccttaggatctagccaaggagtggagatgtttccctaaaatatttcttgttctatttttccagtgtaacaaaatgttagtttctgtgactgctatctatattgtttgaaaagggttgtgtctacatcagccaccagttccaaaaggtatatgtttttgtcacagttcctttgagatcacagatccgcatggtcgcgtgggtaaatgcttcatgctttgatctcttctctctttccctctctgaaagtgggcgttgaaccctcactctgtgctgggctttggggaaatagtacccaggggatgcgctctctgcccttaaagaacttacagtgggctcaattgaggatacagatgaataaacaaggacaacttgagtgacactagtgtaaatatgctaaggaagtacattaggcccaggtggttgctgtccaaaggttttccataaggaagagcatcacagctgacagctgaaggatgtggaggagttaactagggggagaggtagacacagtcccaagcccagggtacaacatgctcagagacccagaggtgggagcgggcatggtgccgtctgggagctgggcttattgtcatgaacacactctagctgccttcactgattgcttccgtgtgttgcacactttattaagtgcctcactacattgtctcccatcacccttgccacaaccctatgggttaggtcttttaatccctactttttagctgaagaaccgaagccattaaaagttaagtaattcttctaggatgacgtaacaagtggagtccatagtcagggcatggacctagtctgctgcccatcttcctccactgcccacgagcatctttgaggcgattcagcagaggggattcaaaaccagcctccatccaaaccagacttgctaacagtggcaccagaaacgacagcaggtcccttatcagagtccacatggttttagaagctgagtgggtaaaacaaaccttccatgcaggaaaatctggagaccttacgtggaattcacttacagtaaagagggtggaaggatgcgtctctcttcctctttctctttctcctgctctttcttcctttcttgagatgtcaaagttggcgagacctaatgaatttgaactgaagaacaatgaagctttccacctttcaaaggaatcctgatacctttaaccaaagagcaagaatggtgctgattatcagtggtattctggtaccctctgaccctggacaaaacaaaagcatagacaacgtttgcctttgactttcgccgtatcctttctactgttctccaacacctggtaacccgctgcctcctccacatgctttaaagcgcccaccccgagtcccttccaaattttttctccctttggccctcctcaatcaaaactctctttccctgagccctcaattaattagatctgattatctaattaaactaattcgcactgaggtatgaatgaggcttaaccctcccaggggacatttgcattttaaaagaggagcttgttaacccaaatgcctcgacaatgacaattagtggcatgtgtggggagatatattttgggaggttgggtctttcctgcgctccctgcgtcctaggccatcacaggcccgggtaaacttcaggatttcctctaccagggagtcggaagcattggagtcagcatcacagatccctaccatctgcgtctctgcctttgacaattggctgagttaaaaaaaaaaatgtcatcgcttaagaagaggattcctactaatactgtgaaacttcagtcgtggttgtgaagtgctttcttttcttagaatcagcctgcgagattcgtgaggtggaggtctaagaattctgagtgacacatttttaagatttctagattgaagatctccagactgaagatctagatcccaggtggaagattctagggccaccccacagcagcaactgtggctgccctgaaacattcaatgttcaccctggttttttttcaccctaagtgtaaatccctaaacagacttttttttttttaagtgggaaagatagaagtatttgtgttccagcctggaattgacatggggaaaaagttgaccaaagtgagagcgtctgggtgagaagcagctctgaaagtcctcatggtcatgtcttgctgtggccttctctgtgaagagatagaaaggctgttttgtttcccagtgcctgtgagctagaagtgaaatagtacattccaacaagatccagattaaggaaaggaactgggaatccaaccaaaagctgctgtactactgaccacggctttgcatttaccaagaacgccaaatgttatcacttcccatcaatggatatggatcccacgtatagacacaaactaaaaatgtgtggggtgttctttttctgggatatgactcagaaatcttgaaaataagaatatggacaagcataatgtatatgcccattgccattatcgattgttttcttaaagccccttggtgcaatgcctatttttgctataattttgggatgcttattcacactttttacaccttttcttattttttggtgcatttaatggcccataaaatgttgagtgggtgggggcaggggctacagtttgacattttgataaagaattgggattttctgctctattttgagtgatggattaagaggattattttatgtgaatgctaaatgattttacatgcattcattcctgtaatatttaatatttaaattaattaaatttcctggaaagataaaaagtgatacgtattattgatgatataagacacagtgttgcatttactcggaatatatatggaaacaagtggtatatgtgctttgcttttcttttttttttttttttttttttttgagacggagtctcactctgtctcccagactggagtgcagtgatgcgatctcggctcactgcaacccctgcctcccgagttcaagtgattctcttgcctcagcctcccaagtggctaggattacaggcagctgccaccacgcccagctaattttttaaatttttattagcgatggggtttcaccatgttgtctaggctggtctcaaactcctgacctcaggtgatctgcctgcctcggcctcccaaagtgctgggattacaggtgtgagccactgtgccggatggtatatgtgcttttctagtctttatattttaagattctaacccttgtagcaaaaacaaatgttaatactgtaaagcttcagaaagcagagctgagatgcaagagcaaaacaaataatataaggggaagcagtaaaaattgtgattaaacctttcatccgattatttttcatttcaatgctatttgagtttttatcttaatgttttgcttcatggaaaagatgagtttgacatctggataacgcattcacaagggaagacataactgtttaccacgtatattttagttgtcaggacctaaaagttaaacaaggagaactgaccagatgggaacaaacaaaattaagttatagttaagtgatttgagttcataccattattattatttttttatttatttttgaaatagcgtttcactcttgttgcccaagctggagtgcaatggtgtgatctcagcccacctcagcctccacctcctgggttcaaggagaattcaaggcaattctcctgcctcagcctcccgagtagctgggattacaggcacgcaccaccgtgcctggctaattttgtatgtttagtagagacagggtttctccacgttggtcaggctggtctcgaactcccgacctcagatgattcgcccaccttggcctcccaaagtgctgggattacaggctattttttaagttattaagaaattacccatatactattttattttactccaatatacttgtttcactattaaagacatgaaaactcttttaggatctctgatcaaagttgatctttcttgataacgatacaaagtaaatcataagggactttttcttttcaattgtacttgaaggctatgggttacttttgtggatctgcaagctagacatcatgaaaaaaacttccaaaccagagaggtttataatcagggcaagccttgatctaccaaaagatttactggacgctaattggctgtaactagtggagtttgtcagatgagctggggacattaaggtttctagattgcattgacttgaaatcaagctcagagacctcctgttttgaagccattacagaaacgtgtttagcactgctgtgtatgcaagaagtctgcatctttagattgctgcctttgagtatgatgtcttaatttgtctttaccaaaatacttctaaatattatcatgggattaaaacaaaagagctcaatttttttttcttcctcaggagttctggaaacaaagatctgattttttaaaacacaaattgctggtgctaatttgcccttagttttctgggcaatatttcttcatttgtttctgattttgacagcatggcctcctggaaaataaaacatagatttccattgattcggaagggaaagaagatactagaacgagaagacatcgaggccatacacaaagaagggaagatagagattattcgcatcttacaccatattttatagttaatctctttaaacctttgtcttcttagctttaagatgccaatagtattattcacctccttatgaggagtaagtaaaatagtttatggagaacagcagcaccatgcctggctacagtcctttctgctctccctctccaggtggagaactcaaattcccatcatataactggggccacagctgaaagccaagtcatgtttatcagagactggttctgattattccaggattcactatgcaggtgacactgtcacttgcatagttgaaaaacagtagaatattggcagtttcctatggtccacccaatactgaaataaataatttatacaattattcagataatatggataagttctttttctgaattgtcttgatctttgaagtaggaaggtgctgctttttgaatggattattttatttctgtacttccattcctcaatacaggatgaaaatagtaattcaccatcctgtggtttcagatttcgtcttcattacttcttggatggaagactaaaagcgtcccctgatcctcagtgtcccaggctcccaagctgccttacgtcagacacaccagcatgtgaatttccaggaccatgtattaaccctatactaagaatagctcctgtagtgtggaagctccccatttgtgtttttcacggtcttttagatgacaagtctagatagggtagatggcctcattagctgttatttattgtgtgatacaagtggagtatagaacaggctaccgggcagccaggtggatagccaggatccaagcatagctcagttcctctgtcccaggcctgggcctcagtgaagttcgagtgactcatttcctctctctgcctctgttactccttcccattcacactcatggactttctcaggcctctcctctgccccatagcctgcgctgctcccacacgaggcctgtgctgcggcttctgcccaggcaccttggtcactcactgcacttcctcggagcctgtacccaggggtgcatcttacgttgaacgtcacctccttcagagagcatcatccccatcccggcacatgtactcatctcactgttctacattttaggaacctgatgtcttcatagcacctgtcgccacttataattaattatttgtatttgattatttattttgttgtctgtttcccccactgaactaaaagctgcatgaaaccagcgtatctctgttccccacccttccagccctagcacctcgtgcagtgccagccatatcctagtccctgagaaatagttgttggataaagaaatatagaaatgaggtggaaacgcctcagaagggcctgtgatgccatggcagacactccaagctcctcagagtagattctcttctcaaatacaaagagttgaactgttagtctggatgccccacctacagtggggaactttgttgttaaaaggaaatggattgtaagcagaaaggaaactttcagtgaaacattacataaaaatggacctcagattgaaagacttaaagattgtttgggaaagtgcagtcttggaattaaataacaaggtagaaaagcatatatgggaatcaagtacttgaaaggaagaactatatcaaagtgaagattggagaaaatgacactcaacaattgaagcacattaaaaaagaggtaatgggatcgggcatggtggcttatgcctgtaatcccagcactttgagaagccgaggcaggtggatcacctgaggtctggagtttgagaccagcctggccaatatggtgaaaccccatctctaccaaaaatataaaaattagccgggcgtgatggcgcccacctgtaatcccggctactcgggaggctgaggtgggaggatggcttgaacctcgcttgaacccaggaggcagaggttgcagtgagctgagatcacaccactgcattccaggcttgggcaacagagcaagactccttctcaaaaaaaaaaaaaaaaaaaaaaaaaaaaaaaagaggtaatggactggccactgcagattgagaaatgaagcttctcagtcactcagaggtaggagagttgtgaaaccactggctggggcttactgaggactgaaagaataatggggcattaaaaacaccagattatctaataatctgtaacaaattctcaattgcactagtttctcctagtattattaacatccactttgttgaaaaatgaaaaacagattcaagcaggggcatgcgtacatctctttgtaaaactagatttataattcaaagagtctttttgattggccactttctgaaatgctaaagtaagactttacaaacaactcttacaatttcattgaatcaatatggagcaagtggggaaaggaaaaggaagcctgtgctcctctaatggaagaatatagattcggaaattatttcatagtacaagataaggaaagaataaaaatgtttttaaaggcaaaacagaaggtgccacagaatgaatgctgcttatctttgctcatgttacacaggaaggttgacattttagtgtgcatcaaggtcacagaaattaggaaggaacactgtctttgagaaatctctaaattacagatcttagagttagcaggcacctcaggataatttggaccaaccctttacttccagaaagtcaaggtgttattatcccccattgtagagatgggacaagtaagttaaattacctgctgaggtcaggtgattgaaaagtgactgatggcggaggatgccaaggacggggggagggagggaagggttaggaaaatccaggccccagtgtgctattaggatgtgccttccattacagcacgagcagggtgattatttcccattttgatatgaacagaagaaaagacctgctgtattcaagtagatctttttttttttttttccttttgagatggagtcccactctgtcgcccaggctggagtgcagtggcgcaatcttggcttaatgcggcctctgcctcctgggttcaagcgattctcgtgcctcagcctctagagtagctgggattacaggtgttcacagccacgcctggctaatttctgtatttttagtagagacgaggtttcaccatgttggcaaggctggtcttgaattcctgacctcaagtgcacaaggcctctgcctcccaaagtgcttggattacaggcgtgagccaccacgcccagctcaagtagataattatttatgagaatcgttttcttcatgaaagaagcaagggaagaagaaggaaaggaaacagaaagaaaggaaggaagggaaggagggagggagggagggaacctctgctgaacatgacaattggtctctcaggccatacagttgaaaaggggacagaaattaccttgacttgttcttttctgtatgttgaattatgggatctgatgtcccacattttcacatgaagatgttgggtacatgttaccaggtcacaggtctgacagtcgagttaaacacctggaggattttgccactgactggagtggacacctggtgacggcttgtgcctacctttggccttagggatgggaggtagggatccactccagtgaagctgagatcagtgttctgcagccttgcacttgctatgtctccacaccaaatgagacttgatattttaccttttcagctgtagaattctctagctcgtttggcatatttgctgtccatagcttccagagcttccatactgcaagcatggtggttggaaggctgaggcttctccacaatccacaggctccctagacttccacaaaacagtgagattttgaaaaagggtagaaacatgatgatggactttccattttatacacaattctatttaatgatgaattacaaaataattgacttcattttgtgctgaaaagacctttgacctctcttagcctggcatttccagcctatgatttatttttaaaaaagtgttttatttgttcattagttttctgttgcatttgaattttaaagctctcctttaaaaagaaaaataaagtatacatttgaaagaagaatgaagaggactgcatcttatgcgtattaagcctctgtagcaaaaggatgattaaaaaggtatatacatgtttcctttcaccgtttcctatatttcctttgactttcataaaaattctttactttggcaggacttttgcagtcagatagagtcaaacatatgccaaccaaagcttacactgttccatcacccctctacgtgcccctgaaattttttccttcttttacttaaaaatgcaactaaactttaaatttttctcagcttgcctgtatgaaactgtttttatttttaaaataacattgatacaaataatatattttccccatattattagcttttattccatccacttcctccccccattcagcacaaggtacggttttgacaggtagcgtgatgagatttagaacagaggctgaagttaattgaggttagcaagaaaaatattactgtcaatttcagattttttctttaattattttaaactcatgaataatcagttaaatgaaaaagaaatgcacatttaagagcatcttgaaaattcccactcctaggtgcgtcagaggagagaagcctcttgtgacactatctacaatagaacacaccactggctttttgcagatgacatagtttttgttttttggtttttaatgatgcttcttttgaagtgacagaatgaatacactgggaagaggaagttgagcatattcagtcataaaaggcaatttgccttttcagtgataacctggctacactatcgcactgggaataagtgtggcacacaactctaaagacagggaattcgggggcctatactgagaaggataaacagccagcgatccagttctgcagaagggcaagcttcagtggctgtgcttccttgggacacgctcgggtgccttctgggtttccatatcatgggaaaaatactctggcctaaaaggactcacttgactaatacaattttcttttaaagactggtaagctgttttatcaaccctgctagccaattagagtgtctggattaattgcttttactggaaaaaaatgattattttgccaaaaacttttaaatgaagaaaatccatccaaaaaagaaaagggagctttctttgaatttgcccacagattgtctccctcccttagccttttctcattttcacgccccaccccacctgttctcatgtgtgtgatgtaagtactctttccaccataaaggaaggttagcatttcgttttatgtagatgcctgtggaaggtgaaagtcatgttaaagatgcttctgtgatctggacagaaagctggggttccctatgggtgattctttttgggtcactctttcagtcatgtatttatttagcaaacttttatgaagcatccaccagtgttcaacagacggatctacttcgctgagagtttgtgttttaagtggtttaaaagtaagacaagtagcataggatatttggtcatctttccctctaacaaaactaaatgtcttttttttttaagttgaatagaaacatcattcataatggtcagcccaaaataatgataacagaagatataaaacttgaagccaagaaactgctttggaaaacaatatttaaggagcgtgtgataaatttgttctatctaattctaaaatggaaggatagtgagggctttcttaacattcagaatgagagctgttcatctgacagtcatttttcctttagagtgctggttttggaggcattctttctcatttccatgtgagaagacaggcttctgtcattaagaactgagcttccaggtatgaagtcctgagatatccatgtattgagactcatcactttgactaatggaagatcctgaccacatatcatcttaagcacctcttcacagtgtgtcatttttccagctcagttgatttttgatacatctcactttatcagtcatcgaagtggaaatttcatcactcttatatgctttctgagtttttcttagtgtttgtttgtaataggttttatgggtgattagttatgggaattgcggcattctcggtgatgggaacctatcttaatttcactcatgaaacctgtttctctcataaagtatgtcataaaccccagggagaatctgttttgcatttaaacatagcttgttgaaattaggatagatgctttttatcatcacttagtatagaaatgaatagctgaaattatttgcatttgctctaatgttggagcattggccttctcaactgtgtgatttcacacgttggttactgtgctgggacgtgccactgactggttgctccactgggcacttgcagattcagaattttaccaaagtcccactgaaccatattatgacataagagtcatatttctgttgtgttggtggatgagcatctttgctttaaaagctttcacaataaagcgtaagaattgatatgacccatcatttcattgtatccaatgcaactgtgtatacctgccctgatagtcaacgcgctgtcattgtccaatgtatacattttacatcatgcgcatctggttttgagccgtagctgtctacttaacaggtgtatgaccttggtggggggggtgacttaatttctcttgagtctagatttccttatgtgtaaaaacaagttattaaaagaaccaaccttctaagtttgttgtagaatttcaatgagataaggcatgtaaagtggacatttaatgaggtactcaatacattttagctatggacattaaactttttaaactctctatttgacaactttctaggcaccacatggccgtaggatcctcagattaattgtatgtgttcattttaatggtttaatttttaattcgaagctttcctcttttgtttttatattgcgagattataattagaatatcctgctcaacgattattttttcaagatagaaattttaccataataaaagtcatggagacatataaatgtgatagcctgattttgttagaatagcatttttgctagatcatcacatttccagtattcgagaggaaaatttaaaatagactatgaagactataggggattggcaagtaaaaaaaaaaagaagtcaaagaaaatgagctaaatctagtagtagcaagtaggagatgccctgaagacaatattatattatcttttctctttcaagaaatttttttttttgagacgcagtcttgctctgttgcccaggctggagtgcagtggtacgatcttggcttactgcaacctctgcctcccgggttcaagcgattctcctccctcagcctctcaagtagctgagattacaggtgtgcgccactatgcccagctaattttttgtatttttagtagagatggggtttcaccgtgttagccgggatggtctcgatctcctgacctcatgatccacccgcctcggcctccctaagtaatgggattacaggcatgagccactgtgcccggccaagataattttttttaattaaaattggctgtattgtctcatcaaagttcacatcaatcaggaaatactattgatgattgaagacctgctgtgtacaagacacaaaggcaggcaacactggagtaggtttttctgttgggatgactgtgaattttgaagcagaggagggggtggaaaatgatggcacaataaaagttcagttacaatcagcactcctgcttctcacctgtcgtgtccaatagagagttgaatctgaaacgggaatgacacagcttaaaactgtttggcatggataggggatttgtggggttgtgtagatcccttattgtcctccagtggtttgcagccaccgtacttcggcttactgatgtgctgcacgtgaatgacaggtgctacgacagtgattcagtctgtcgaggggtttttctttctttctcttttttctttttcttcttctcctcctctgtcctcccctctcctcttttcttctctctttttattcctgtagcaggagacacaggtggatggtaaggtctaatttccagaaagctgagctttgctgcttgtgaacgtggtatctttggctaccactgagggttagactcaggtccactacagcaattctgacatatttactgaaatctgtgaggtttttgctctggaagtatagaagaggacatggtcaaggcagtaaacagatctaaaaaaaaaaccacaaaaacaaaaggaacagattgttaacaaataacaagttctgaaggccagcaagtaagacagcttttgtttctttatcaatactgtaaggtgctgatttactgtaaaactaattgcattataattggatgtggcttttcaatgttgttttgagtcttttattccttccaacatgccaccaaaatgtttatttcgaagtaggccgtgaatactgtgctggaggatttgttgaacaagaaaactaggtgtagtcagactaaaaatgttattgtggtgatccatccccagatcatggaagagagttattattcagaatctgcattttgatggtattcactttactgatattttagccataatttatcctctttcactacagttcttaaactaggtccttccgatgtgtgtcccagttctctttcccggttacacgcctctacttctgcacagcggctctttgcggccttcctgccttggccttggatggaagggtaaccccctgcagagtattcaatgatcagactgtgtcctgtgtatgtgactttgcagcaatacccaatgccagtttgatgcgtggtgcttacttcacagaagcccatttcatgtagggcttgggaggaagtcgttgctatcctggatgttcttacgttctttagtaatggtggaagggaaagaatttcgtacaccattgttattaacaccctgaatcctgcagatctggccaaagggagggtgaccctagccatctgggaagtgtgcaaggcagaagcaccgtccatatgggaggagctggaggtgcctggccctgtctggtcaggtggtgggtctggctgatcttttccccttcagcaccaggaagttacacaaacctgtacttcatgcacccaaggagaagaaagagggccccctcctctgtcccgtgatatgatagtgaaccatacttacatttgaaagatagtttctttctttctttttttttctttttttttgagacagtcttcctctgtcacccaggctggagtacagtggcaccctcatagcctgcaaccttgacctcctaggctcaggtgaccctcctgcctcagcctcccaaagtgctaggattacaggcctgagccaccatgtccagcctgaaagatgttttctgaatcaggtttgtacagccaagttactttgaaagcatacgtgaaaatgtttataagttataatacattttatatgtatgttattatcataagtagataggtgtttcctacttgaatctttgagttacctggatgcatttcttaaggagagtttataacaaaatgttttaataggaaatttcattataataatttgaacttttcccatttattgctttttattattactggataaatattgtgatactcctggtgctctgaaccccatctgagcagaaacctgtagtatctgaggactcttgccaataacataatggtagattgtgtcaagaatatgctcttcatctgcctagggtttcatgattttcaagttgtacatactagaaaggttctgtagataaagtatgagaggagaaaggcattatgtacattagttgaaattggcatcatgttgccaaactgtaataagccttaggggagctcagtgttgaaactactcaattgaatgctgcaatttcccataacaatttaaaaggcctgcaggcatgctaaagtcatagctggatctttcagttaacactctgtaacatgaccccaaagtctcatttacatcacagcaattaaaatatattccacattacacgtttactaccacatactgtagaaataatccaatgaaatgtggctattttccaaaaataatatggaaatcttgatatgatacgtattcacaatttcttctttccaaagtggtatcaccattacacacttgtacatacaggataatggtaattgtgaagggggaggaaagtggggcagatgaagaggaatgcagcctggactgatgaaaactagcaatcattactacttggtgacccacaggaaattggttttgtggtctcagtccggttcatgggtgacaggtgtccattgtgcaaaataatcatcgtaatctgtgctaattggccccctactggtagttagaaagtagagagaccaaaaattatatgagcacaaagaacccttctacacctcctggttgcagaagggttgcctctggactaggacaaaatgccaacacccagttgggaaagagatggaaatgtagagtagcactcacctgaggaaggtattttcatgaatttagagtcctttccttaatgctccatccaaattaaatttaaaatcctcctgacatagggattatagctgtaactattaattgatatcataactattttgtaatgagctgaacagcaaattgaattactttaaagcagagccgtggtgggcaaaattagatcatattttctcaacagtgacgactgcattttagcaatgcctccctttgaggaaacgtagaccaaattgacttactccaaattgttgttgtggtttaatatttattgaatagccacaatttactagcttaccttgaaagtgtggtttttaacagttgtctagaatacatcaccaaggtatgaaatacagtggcaaaagtccagcttctccacttggcaggcagtcaatgggaaaccaaggaaactgccttgctctctgtgcctgctggaacattcttgcctgcactccccttttgtggtcaggaagagctttggaagaatcctactttagcagacatctgagaacgcaacatttttatctactgactaggtccattttaatcctctgccgtggtttataactaccactagtaacagcattgaaacaaatttaattgggccacttactcaagagcctttgtgtccattattgggaggtgcctcctttgagcagacacagccccctcctaggggtgctgaactgggcaaccgcaaagcacaggctggattgagccccccaaccccctcagcagatgacccgatgcctgggttgggcgttgtctacctgacccatgaaaactttttaaaattatagattatgcacatatttggtttttttttttatgagacagggtctcactctgtcacccaggctggagtgcagtggtgcagtcatagctcactgcagccttgaactcctgggctcaagtgatccttccaccccagccttctgagtagctaggcctacaggtggtatgtgccaccgtgactggctaattaaaaaacaaaacaaaacaaaaaaacttgttttgtagagatgggatctcactatattgcccacgctggtcttgaactcctggcctcaagtgatcctcctgcctcagcctcctaatgtgctgtgattacaggtgtgagccgctgtgcccaacctatgcatgtatttgtctttatgatataaatcatctaggaaatccagaaccacaaaggtataggatacgtgtttcctatttttacttgactatttggcagtatttatacaaagtcataatatttgagtgtattgtgcctatgcattttaaggtgtgtaactaaacttgagaagtccaaacagtatatttctgtgtgagcctatacctagtcaagcatatttatattccccaatactgttgcattacaatgtgtttaaaaacaaacaataaacacccacgaagaaaaatattctagagaatggaatcctccgagtaagcacacagaccgctagccaggctggctgtttcccctacacattgatactgagtccagaaccgacctagcccctactgtctccacagcaagctcagagactttcctcagttcttgggacgaatcagacactcagactgaacccaaagggtttttgggatcctgaatctactctggaacttatctatcccctagagcttacctccttcaaggaggaagtggggtttgggaattcgtctgtccactgacagatgccatgttgacggagacacctgcattcgcatcgctgagtgcgaatttcccactttccagggatccgtgaggaaggtgccgtgtggctggtttgctgcttttcagactaagatgagagctgtctggtgggcagtagacagtgtatatgtttattatagtaattttgcctgtgggtaacagaggcatgaataactgcagttatcccttattctccaaatacttgggggtagttaccaggtcttcacctagttactaaaataagcctaccagcattcttcagtctggagactcttcatcagtttcattcctcctcttgaaagtcctgccagcgtctgcctactgctttctactaccaagacaaaaatatttggataacattagacatgaaatcattttgaaattattggtgtgggaacaatttttttcttatttgatgacatagtccctctgaataagctcataaaaattcaaaactcaaattctattcacacattttagcaaaatagcaatttcgtaacagaggtataatctcttgctctcaaccgtatagactgggctttggtgtatttttcgcaaaccagctcccccagattactgagatttaagcctaatgacagcggacatgattctcggacaccgggcaatgtacttgatgtcattatagtagctgccctttatcaagtactcattatgttatgtgccaataactgtgctgaatgccctaaaaaactttatctcatttaatcttcataatatctccgctagaaaggtattgtcatatgctttttggataattaaaagtagtaaactaagcctcagagagcttaagtaacctgtccaaggccatgtgtcacatcatttgtaaatagtggagctagactttagacatagttttgtctgattacaaaacctgttctctgtctccttcccagttgtattgatatagttttttcagttgaaatatccagggtaagaacttgttatttcagaagcatatttctttttctttaaattcttatttttatttatttatttttaattgagatgggatttcactatgttgcctaggctggtctcaaactcctgggctcaagtgatcctcctgcctcagcctcccaagtagcttggattacaggtgcgtgccaccatacacagctctcagaatcatttatttctgtcagtcactgaggtctgcttcttctacgtagacgtcagtgagcaggaggcaggctttctccaaatgacggcaaaaatgtaaacaagctacaagtttacatcttccccttagcaactctaatgaaaagagtaggctcattcccagtagtttcaccagatgtcccaggactgacctcattggtcacatgttcattcttaaccagtccctgagactttgttcaggctgttcctggaccccacgactggggtctgttccaccccaacccctttgtctccatgtgggggaagggtgtttttttttttcagggaaatacatgaaacaggtttttttgtttgtttgtttttgagacagagtctcactctgttgaccaggctgcagtgcagtggcacgatcttggctcactgcagcctccgtctcctgggttcaagcgattctcctgcctcagcctcccgagtagctgggactacaggcgtgtgtcaccaggcccaactaatgttttttgtatttttagtagagatggggtttcaccatgttggccaggctggtctcgaactcctgacctccagtgatccacccgccttggcctcccaaagtactgggattacaggcgtgagccactgtgcctggcccacaaaacaaaattagtacagctaccaaggctgtgatggaagagagcctgtctcctttgataactgaaccacataggatgacagacaagcaaagagaattgtgagcacgtctccctctgaaacacataatatcacaccagggtgtcatttatgttcttctctaatcgtcttttccctgaagaagcagcttgaaaatgttttcagtagattttatcctcttggtcttacattttacacctttcttactcctgagttgaatttcacttggcttttatttttgcatccccaaagctgtgatctctgcaaatgtaattttcaatatgacagccttcattgactttgttaatactggatctgttgacatcctgacatggtttgttaaactcattgctgtcatctctctctctcttttttacttcttaaaaaattttatctcttaaatctcctctttgttctaaggtttggaagtatagtccagaggttaagaggagagatttggaatgaaactgaaatgtgttcaaattcagctcaggtgatttctgactctatgaccttggatgggccagtgaatctctctgggcctcagttctgtcatgcgaaaatggagttgataattcttatttagcaaggttgttgtgaggattaagtgaggtcatatatgtaaagcacctggcatattttaagcactcaataaataatcaagattgaaattaataattcgtcaaggagcttttatgtccactctgaaagagaggaatatgcccagcacttagggaaatcacatgagctcttcattgaagaagctcccccagtggcacacagacttcccaactatcactgggccagtgagacccatctttaaggcactttttaaatatggaaagctgtagttgttttgaagtcatctagaaaacttgcttttctctcattacgactaaaggtttgaatttggacttgatgctacacaagtcttaccgtttggcaacttttccaagaaataaatggaagagcaccatatgggggtgtgagccccagcctagccacactactggttagttgcatgacttgaacatttttattagttgtcatagttcctcatctctataactggcaataacacaaactggctgtgttgctgttaggtttagaaatgcaatgtgtaaaatacccagcatgaaaaagcgtttaataaattgaggttattggcttggtgtggtggctcacgcctgtagtccccagtactttgggaggccaaggcctgagaattgcttgagtctggaagttcaaggctgcagtgagctgtgatcgtaccaccgtactccagcctgggcagcagagcgagaccctgtctcaaaaaataaagaaataaaatagaataaatagaggttattattattactgtgtgtgtgattgtgcctggcatgtccactgaggtggacatgttcagccgaagatggaatgacctacttcaatcagaataagacatctggagtgatatcaaactgtctatttggttgtttttttacctagtgtgtttgaggccattcggataccacagtattatctgaatgacatataattgtgtttcttacttttccctctgaaccagatattattactggcaaaattttcaaagtcctggctcatgccgaagcgcaggtgaaaaaagtagtggcctctatattcagggtgtctgatttaagccatcatagaaatgtgtaaataggtatgatggatattggttgatccaggcaggcagacaaattgagaggtattatttacactttaccctaaaggtctgcaagcttggaaagctgcatttggctcagctgtattggatccttgagtgccttttcccatctattctaagtatagaaattatgacctcttccctgtagttattcctctgtttgcaaccacaaactaaatgactggattaatatatattactagtgtctattaaattttctttccataatttttatcaggaaaaacagaattacttttattttcaaaccatgcaaatgaattgttttgttttgaaatcatagaatatattctcactttactgagtaaattaaccttattatctttatttttttcttttttgatcattttcagtttttgtttccttctacataggaatatttttgaaaaaatttttaatgcattgatgagagttaagccacttttcttatagcctaaggcactgttctatatattttccaattaaaaatctttcagtattcacagttattcagtagctattttaatatatttcctaaatatactatttatagttctatatattttattacctaaatttacgtttattcatgataattcatccatgatgagtagttttgaattttaaaacaataagttttctgttcattatactaaaaataacaacataaatatatctttatcaacatgaaaatgttcataatatattaagtaaaaatgggttacaagattatccattttaaatatatatatatacacacatgttcatatatacatacagcatatgcatggaaaaagtctgaaaaggtgaacaccaaaaagctaggagggcaattattattttttgtcttatctgcattttccagtttccagaaggaaaaaatattacctgcttaatacatattttaaatgaaaaaaaaacagcaaatattgggaatgtgtattaaacagtgcttaggggatggcctcctgttttctctctctcaggagagtttcctcttcactcagctgctcaagccagaaagttggtatcattctcaactcttttcttttcctcaccctcattttagcccatcacagtcatgctgatgccacctctaactatctctcatatccatccatttttctaaatctccactccatcccttttcccctattttccatccttcagccagagagatcttcctaagctaaaagtctgatttatacaattataaatacattgattttctttatattctgtctcctttctcagattaaaagagggcacgggctggctgggcgtggtggctcatgcctgtaatcccagcagttggggagtccgaggcaggcagatcacgaggtcaggagatcgagaccatgatgaaaccctgtctctactaaaaatacaaaaaaattagccgggcgctttggcaagcgcctgtagtcccagctactcgggaggctgaggcaggagaatggcgtgaacctgggaggcggagcttgcagtgagccgagatcgcgccactacactccagcctgggcgacagagcgagactccgtctcaaaaaaaaaaaaagagggcaggggctacgtgttgtgtattcctgcattcccattgcttcttacaatgtcatgtcaccatgacagctggtagcatttatacatgtaggataagtgaataagtaaagaaatcaatggtcactgtgctttgtgcacaatttcatgtctatacatacagatcagctgcattcttttgaatcactgcacagcattcctctatctggtcttgtcttgctttttcatccagtgtgacaatctctgccttttaattggtgtgtgtaaattatttatgtttaatgtgattattgatagagttagaattctcttttttcattcatttacttttaacctatttgtgttgttatatttaagtgtgtttcttggaaatagcatctaattggatctttaaaaattatccaatctgaaaatctctgcattttgtggagtttttagaccatttacatttaatgtgatttttgacctagttgggtttaagtctatcatcttgctatttgcatttgatctgtaccatattttccgtgttcaactttccccttttactaccttcttttgattagttgtatatttttatgcttccatttttaaaatttctgtttcccctttcgtgactgttagttataactatttgctttgctgtttcagtgccctgtttagggtttaaactgtatatctttaatataacactgtctgccttgacgtgatattaggtcacttcacataccttgtaatagtgtacttctgcatgtcctctcccttcctttatgctattattgagatatattttacttacacatgttataaatgctacagtacacggctacgatgattgcttagttatctatatttaaggagatttaaatagtaagaacaatatcttatatatttaaccacataccattttcaagtgctgtttattcctttgtataggtacttatttctatgtgattttgtttttattttgcctgaagggcttcctttacatttttttgtaatgagagtctgctgatgatcagcttctgtatgtccaaaaaggtatttatttcaccttcatttttgagagttattttcatgggatataaaattctagggttttttttttctttcagtactttaaagattttgtcatttagcttacattatttcctgtgagaagctctgtatgtgatgatgcctttttcctgtgtctgcctttaagattttctctttatcactggttttgagcagttaaacataaccaaatgccctggtgtagttttgttcacatttcttgtgtttggggcttgttgagctactggcatctgtaagtttataatattcatcaattttgaaacatcttcagttattatttcttcacatttttttctgttcacttttgtctgtcttcttcttctggaattttgaccacatgtatattggtctcttaaagtagtcctgtgtctctctgatgatttatttatttatttatccacccattctttttctgtgctttattttgtgtagtttctattaccattttgagttctctgctcttttcttctgcagtgtctaatctgccattaatcctattcagtatattttttatctcagacattgaagtttttctcttgaagtttgactttagccttctttttatatatgccatgtctctaattttttgattgtatgggatgcagttattataaccattttcatgtccttctctatgaattcttacaccaatatcacttctgggtagtttcaattgattgatttttctctatattattttccttcttctttgcatacctggtaattttttattggatgtcaaccatggtggattttatcttgttgaatgatggatatttttatatttctgtaatattcttaagctttgctgttgtgcaaaaagaagttaagcgacttggaaacagttagatccttcctggtcttgcttttaagttttgctaggtagaaccagaactgtgtttagtttactgctaattattccccgcaactgaagcaagaactttctgagtacatcgcccagtgaagtatgaattttttttttttcccaatctggctgctggaaacagacactattcttggccttgtgtgagccctgtatacttactttacctgtgattcagtggtcctttagaggcaaaattttgccccagggacatttggtaatatctagaaatatttttgattgtcatgactggggctgctcctggcatctagtgggtagaggctaggaatactgcccaacatcctactacaaaatgcccccactcccacaaaaaaggaatttttctttcaaggaggtgagtagtgctgaggttgagataccctgatacagtcctttcagatcattctttctgtgccctccagtggtctcctcacacacttgtgtcgatcagtactctgtggaacaccccagagggacccttggcagatcctcagaattctttctccaagtggctctcttttctctagcaacttgtcctgcaaattcttaccacctgttctacggggctcagcttcacctctaattgtgagggtcttctggactcttcctgggtcccccttcctgtgctacagtctggaaattttcaaggcagtaagcaggtgtgatccatggcacagcttaattgtttctcatctctcaggattcactgtccttcactgactgatgtcaatggcttgaaaactgttgttccagatattttgtctttttgttgttatgttttagctatcagggtaatccagttcttgttactgcaatcttggctggaagcaaaaggtggcttcttatttattattgctgtcaaaagttctctttgtttactgtcatgtgtaaagaaaacaacctgcccaactttaacctcctcaatcactattcattatattgatttttctctgtctctgaatcttcccaacaagtctcacattttatattcatagtagattccccttttcctatatttcctttcacagtctttgtggggtgttttttcgagacagggtcttactctgtctccgaggctagagtgcagtggcactgtcatggctcactgcagcctccacatcctagcctcaattgatcctcccgtctcagccacccaagtagctgggactacaggcatgtgccactgtgcctgtttttttttgttttgttgttgtttggtttggtttttgtagagagagggtttcatcaagctggtcccaaactcctgggctcaagcaatgttcctgctttggcctcccaaagtgctggaattgcaggtgtgagccaccatgcctggccttgtgttttaactttttaccgctaacatgatagttagattctcttgtgttctactatttgaaactataagctcaaattctagttatgcttgaatttagcactaccaaaaatatatatatatatatgattttatttttgtacttaattatttcaatttttggatttatacatttgcctcaggaaacataattttctctaaaatgaacaaaagcaattgatttcctcaattattttagctattcaataaaggaaatgctttgaaattcttatggtatgcaaagttgtatttactgttcaattgatataactggcaataaatcataaatactaacattagtgaaaatacaaattgtgagtaacaaaaggcaaaaattttttggtactctgtacaaagaacttaatttagacctttaatctaaaatgtgttggtgtaaattagtgttgctttgaagtctggttattgtgggggtgagcttttccagactataataaagataggaggacactatatagagatatccaaggtaacattcaaggctttgtaatttgtacagaaaacagataaaaatggaagcatgagtgagtttcatctagaggttatttaatcttttgggtttggatatttgttatatttcagtctctacatagatatatataaccttatggaattttagaactacaattgatgttagggatgtttgataaattgtaatcattggcatcaagggttttaaagatacaaaatttacagttaaaatcaagttactttctaaagatacaattaaaagtatttcatcaggattaggaacatgttataaaacaatgtaatgatgtcattacatcattacattacgaaacttctctggccaagtttcaaaatatatttaaataatacatctgaaataaaggataggatcaacctaagtttagtgtccataaggcagggattgcctgcccattcattcattcagtcaaatactttgcagagtgttgggaagaagcaaataaccaagtaatccaacttgctttaagcccagctgtggtttccagaggagtgctatggttagtagctgagttgcgtttcaaggagctaatgaaaattaaccaactcagcttgatattgttgtgtgtttgctgtagccagttcaatcagaagttttttatctgttttgttttttgagacagagtcgcactctgttgcctgggctggagtgcagtggcatgatcatggctcgctctgtccttgaagtcctgggctcaagcgatccccctgtctcagcctcctgagtagctagaactacaggcatgtgccaccatgcccagctaatttttgatttttttatagaaatgtggtctcactgtgttgcccaggctggtcttgaactcctgggctcaagcagtcctctcacctcagcctcccaaagtgctgggattacaggcatgagccactgagcctggccaatcaaaaggtttcttttgtttgtttttttgttttttgttttttgtcacctttctaatggctttccttatttttcaaaggctttgcccactgatgcagctaatgtcatattcattaaatgctgtttgctaaatatgcacacagtgaccctcttccttgtgtaggactgtgcagtcactatcaaagtgctctaacaatttggcattacttaagctgcatttcttaaccttctcgtcttcagccttgagtggaagagataacacagaaaactgccttttgaagtcatattgaactcactgacttccatcaatgaagcatatcagtagttgcaaatattgcagtgtagattaaatcctcgaagagtttgaactatgtacgaaaatgaaaaggagatacagaggactttttattgtttacagtctaagatcaaattgcctcgatctttgatggcataatcaaatactacatcttgatgtattgtggcactggagaattgcttcacaaataaagaaaactcagatatttgatgctagagatgttttagaaagcttaagaatacctaaaatcatctttccattactaggtgttaacatttagttggtattgatttataaactttagaagtattaccacaaagttgcatctttaattgctattactgtgttaaagaacgtactgattatctaatttgcaagattataaaatggtatcatgaaaatgatacagtagagagaatactttttgcccttgaagatccaaatggggccgggcactgcagctcacgcctgtaaatcccaaccctttgggaggccaaggcgggcagatcacctgacgtcaggagtttgagacaagccttgccaacatggtgaaaccccatctctactaaaaatatacaaattagccgggtgtggtggcacgcgcctgtaatcccagctatttgggaggctgaggtgggagaatcgcttgaacaagggaggcagaggttgcagtgagctgagattgcaccagtgcaatccagcctgagtgaaagagtgaaactccgtctaaaaaaaaaaaaatccaaagagaatggaaagacggatggtttaactcagaggtttacacactgttttctctaaaggaccagatagcaaatagtttagactttgcaggccatcaggtctctgtgttagtttcctgtggctgcagtgagaaatgaccacaaccctggtggcttagaacaacaggaagttattctgtcagttctggaggtaaaaagtgtgaggtcaagggccacacctctgcggtccagagaagaatctgcttcgcgcctctcttctgacttctgttggttgctggtggccattcgtgctccttggctttcagggccattgctccaatctctgcctctgtcttctcctggccttctttcctatgtgtctgtgtgtgcctgtatccaaattttcctctcctgtctctcataaagacaccagtcattgcatttagggccctccctaatccagtatgacctcatcataatcttactacatctgcagaaataaaagtaaaaccccattttcaaataagatcacagtcgcagatactgggagttaagatttcagttaagatttatcttttggggagacacaattcaaaccactgcagttcctattgcagccactcagctctgtctttgtagcatgaaaatggccaaggacaataggtcaacaaatgcaagggctgtgttccagaaaaactttacttacaaaaacaggtggtggatccgatttggctggcagagtttgccagtcaatacctggtccaactaattgaagcaaaacagcagcagagcagaaaacgatttccccttgcttcaatcagttcagttttaaagtaccaaaatgcatacatatgtgtatatatagcaacacttattttaaaatagatgtcaatttagggcaagaaatgaaacttttataatgacttcaaatcccgaatctttattactaaaaatgctcgaattatatttttctgatcaatgaaaagctttttaatgatcatttagttttcggtctatagggccctccctccaaaaagatcaagatgatttggaaacaaaatttccctggaactgagacatatttattcactctgtcagaaagaatgtacctgtttccctgactaaatgtatgccccataaggacaggaacatttatccactctttgtcctcagcacctagaaggcagcctagcacatagtagtcacccagtaaatattcatctaaaataacttcttggggccgggcgcggtggctcactcctgtaatcccagcactttgagaggccaaggcaggtggatcacctgaggtcaggagttctagaccagcctcaccaacatggtgaaaccccgtctccactaaaaatacaaaaattagctgagcgtggtggtgggtacctgtaagtccagctactcgggaggttcaggcaggagaattgcttgaacctgggaggcaaaggttgcagcaagccaagattgtgccactgcactccagactgggcaacagagcaagactctgtctcaaaataataataataataataataaaataacttctcttggccgggagtggtggctcatgcctgtaatcccagcactttgggaggctgaagtgggcggatcacgaggtcaggagatggaggccatcctggctaacatggtgaaaccccatctgtattaaaaatacaaagaagtagccggatgtggtggtgagctcctatagtcccagttacttgggaggctgaggcaggagaatcacttgaacccaggaggcggaggttgcagtgagccaagagcgcgccactgcactccagcctgggcaacagagcgagattccgtctaaaaaataataataataaataaataaataatacttctctttgttggaataaaaagagtgaattggtgtgttgttgttttaatcctttggtataaaaatagtctgtcaccataccttgaaattgtttattatttcaatttaagtttgaaaggaaaggtacaatatgagaaattcagtttctcttaagagctattggaagaatttgtaaatgtaataatggagtaatgaatcagaggggtcagtgaaaaatcgttttttaaaataaaaaccaaattcatggaaaagaagacaaaggtagagaaatcaagatatattccaagactaaactaaaatattagcaactactttgaacagctcagtatttggtagccatatcggtatttggaagcagagaaatatggaaccccacaagggaacccttcattggcaacatggagagaggagggtataatttggttgaagacatagcagggaggaacactccaaaccttcccaggtctgggctgtggaactctgtgattattccagcgcagggagtcttgccactcttcttgtagctgatggaaggcaaaacttggaaagtgaggggtacatttgtaacgttacaacagaaaggatcaagaattcttgacaactccaggataagctgagttgacatgggagagagtcagccacaaggctccaagttggaagcacattaatgagctgtatgatgtgtatactgacagtgcatgctcgagagagtgggggagaaagagagagacagtcagagacagagacagacagagacagagacagaccaagactgagaccagagacactgattctttgagagagggactcactttttttggaggtgaagaaactactatctcaacagcggtcacggccaaaggatactacaggaaccaaggagaaggcctgaggccagttgggaaccattgatttcaagttgactatggaatcactcaaagaaaaagtgaatttaccaaaaagtgattttagtggggtgggaggaaaacacgaagggctgaagataaagccttcggggtccttcagattaaaaggagagacaacatgagaaggaataaagataaaggagaaccatttgaaatgcggattcgccccgggccactctccctcttgaaggccccagtcttttgccggcagaccctttcctcccaccctttccactgtcagttcagcaaattcaggaaatagagagtttttaagcagagcaacaccatttgcctcgcttattcgtgcagttgcaggaaactccccccatcaaattagccccttgaattaccttaaatatcacgatttgcgctgattaaattcatttgctagagaggaaaatccattttaagcagaatggtatggggaggaggaccagctttttccacagttcaagacatttgagttcttaaaacatgaaaattgtgccctctgaagaaagagtctttgtaagatatattaaaaaaaaaaaaaaaaaagttcaatgcatttgacaaagtttcagtggcaagaatttcccaatttgttcctgctctttagaatacattgaaaaagaaaaaaatagtgtacgtttataagaaaatgaaagggaatttattttgaatggagaaatgctataaagagaaaaagccattctaacttttccattgtggaaaatttaacaaactattgaagccaatttttagctggcttctgtagtgaaatttcagcgtgagcttacaattttttttttgtattaatggggaaaatcagatacagtagcttcaataaacactcatagcactcaccagcagaaagcgtgcttcacctcttggtgatacaatgtattttacactgatttcagaaatactaatttcttgttgaaagcaagtttcctagataagcaatactattgtttcctaccatcccagattgagaagggtagagagtagccagtttttaggtgaacgtcatgctgacctcatgcaaaccttgtatcttcacagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggtgggtaactgtcctagtaaaataaggcaatgctcacgttactaacttgtaggtgtcgtgattttcccctcaaggtgacatgtctgttttctgactttggcgttccatctgctgattctgattttgagatattagatcatcatgcagtattccagatgagagatagaaagccaccggtgggcacattggtgccccaggcacaggcactgacacgtggagaattccgaagcctcacctgctatacgtgaggtttatgattctgcacgtggcccaagcgtttgtacaaacttgtgtaaacttgaaactccagtctctggggctcccttttagttgaatgaaggtgctcacagacattgtgtctgtggctagaaccggtacaaggagaacaggagctgttggtgaagaaacccatctttccctcacaagaaagtgtggcttattaccccagatcatctcaggacccaagcagtcctgctgtttgcctctgtctgattcacacaaaagcctgccacggaaaggttccattgtctttctcccaggcaacctagtaaattaagtttataccttaacacttcctagtttcccacaatgtaatccactagggcttggtcattcgcgtctatctgttgaacatttttacactgtttttggcctgaggatgctcccagtggaatcatgactcctgtaactttacttcactctcctaaacctacccatttctactcttaagacagtaggttattttttattagacatacatagttatattttgtttcttctaatacagtcttgagatgtgggcaagattactaataaaaataaaatcctcttacatttgtaatgtgcagtataatttacatataacttagcattctttagctaatttaatctggaaatgagaaaaaataaattaaactttaataataaagaatatattcattcttttccaatcaccgtacagacagtgtgactaacagtctgatattgggcaggaacacatttaagaaaaagtaataatgcaataaatcgttcaaaagttggaaaattttccatggttcttttcttccctgcattgtgcaaagagccattgtaactagattgaaatagtgttcactcacccaagccggtttacatcaaagaaaactcatttgattcgctaaggagagatttttataccctaaagcatgccttactaattactggtatcaaattttatgaaaagggacaaaatagcttaacatttttaatccgtttttcaggggagatacaaaacatatttgaggtatgtactcttagttgactgtacaatgtattgtaattttaaacccatttttttcatattgtctgcacagctgaaatagattatcagtgtacattttttcaacaatttaaaaaatagtaagtagtgtagaaatgcatgcaatctgcaccaaatgtgaagtcttgctttttgtatcaaaaataactctttagtgccctgttggaaaacgaaaaaaaaataaaaaaattaaaaaaacccaaactccacattgtggaatattattcgaaggaaacagcagcacatgtggcgagatgcactgggggtcatctccaccccggttatctccacaccaggcaagcatttctttttggcagcacagacgatgcctacacaggttaaaaatagcgcactgaactgttctcctcctaggcagccttgatccagcgcagactgttgttgacaacccggcggtagcatttgtagaagccctgaaacggaggttcatagggggccaaagagtgttattcctcactccttccaagccaaggactgcagaatccaaaggggcggaggaaagagaaagggcgccaggcggccagggaggccttgttggagagcagaagtgaatggagaagcgctcgcgcagtgtgtgatggtgccgcaggtcacttgatgtgtatgaatccgaactttgtagaaacgtaaatgggatggactgctagttacagctaatgctgccaccctactgcgtgctggtcagtgcgctaggcaggtgtgtgaggcagctcccctggtgaggtgggtcccggtagcgtagtcttttcacagattgagacggatgaggtttggagaggctggagaccccatggctcctgagaactaagctggaacttgagcccaggcttgcctggttctggcctggcttctaatctctgtgcagttgccacagtggaaaacaggcaactcagtaaaatatcaccctttgatttattgcagtcaattttttaagtctattatcattattattaattaattaatttagtgacaagctcggtctgttgccaaagcctgactgcagcggggcagtcatagctcactgcagcctacagctcctgggctcaaaaaatcctcctgcctcagcctcctgagtagctgggatcacaagtgcacaccaccaccatgccagggtaattttaaagacattttttttaatagagacagggtctcgcttgttcctcagactggtctcaaactcctggcctcaagcaatcctcttacttgggcctccctaagtgctgaaataacaggcctgagccaccacgcccagcccattttagtcaattttgaattcgaatgttcatggtgtggatagtgaggtgtgagcaaactgtaggcatatttaggaaataaaattgatatgattctgtaattgggtgaatgaggacgagtgtgagggtggcgttgcggatgctttctccttcctgtggtttgatatgcggagtatttgtagcgggagtggtaggtgtaggagagaaacgagtaaggaaagtctgctatcagattatgtttttcttgagcaagcataatgagaaatccttccaggctttcattttctttgaacctgacaaatgtcaattttttctcacggactattatgctatgggattaattatttaattgagaaaatgtgcttcctgccacagctcctgacatcatataggtcataaaaatgaaagattaaaaatattcatagtagccaaatatcattgaaacaattccaaagagtcatgctaatttagctttttttgtccatggagttttaaaacagctgatcagtcctgtatccatttactccttgaatgacacagggaaatgcaacttcggctggagaaagggacaagcagggtttccgttggtgcgattatatggagaattcaaatcgagaaatatgatgtttttatatttttaattgaccaattttatgtctaattatcaaacttgaatttaatggttttgtatggctttactgactggcaggtgactactgttaattacatgttatatttaggtagcataatgctggggatcatttcttcttcacagtcattgtgtaatttgacgggatctcacattgatctctttctctttttaaatctcttcatgtagtttgttggtgatggaaatgttgctctttgaacagctgtggagcttttgctgtaggtgagggtgaggttagggtaacaatggcttgttttgcattcttagatgctattttcttttattaatctttgaagaaaatttatcccatcaggtctcagacaaatttcttatgaaacagctgcataggatcatcccacagcttttggagaagtggtaaaataaaagaacatttttcctctgctgcagctctgtgggctatgcacatgttctgtagtattcttgaccaaacacttatcaattccaacaaggaacgctgcccgtgagggtgaaccttgaaaagagacgatgtctggaagtaagaatacatttgttccactgaatcataagcctgaaaagaaccactttggggccctaacccaaagtatataagagttagtcaataatcagtgttggggttgtgaatttcagaattttaacatttgaagactaccacttattctttatttgtagagtggcaatggagaggaaggactctgttttttgtttttgtttttgtttttgagatggagtctcactctgtcgcccaggctggagtgaaatggcatgatctcggctcactgcaacctctgcctcctgggttcaagcaattttcctgcctcagcttcccgagtagctggaattataggcgcctgccactacgcccagctaatttttgtaattttagtagagatggggcttcaccatgttggccaggctggtctcgaactcctgacctcaggtgatccgcccacctcggcctcccaaagtgctaggattacaggcgtgagccactgcacccggccaggactctgtttttaaatttgaaaaacaccgtgatatctatgtttgtacgttactgaaattaaaacagaaagtaaatttgcaaagaagggaaggaagaaggaaggcagtttgagaacgacaggcactgattgatttctaagtgtgcctcatctctggtctttgctgacagcgtggctccactcccagaaactcccctctttgggccgtgccgtctcttcattcttaccatcatcagtaatgctgagcactcccagcccccagaagcatggcttctgcttctcacctcctgcccttgctggttcaaggccagttcaagtgtagtttgggggatcccactggggagaggaaagaaagagaagagggaaagtagatcccacaaggcctgattccccactgccggacctcccttatgggctgcatcctgagcgctagcccatcttgtatgcaaacattccagatgctagacctgccccttaccaaggataacccttgtgaggaaacaaaaggacattagaggagtagtctgaatgttcctgtaaatatgtatcttggaccctggcatgatggtggcttgaatgagggctcatccactcatctcccagcagactcgctacctcctgtgagctgagcagtgatcgagggtacacatgacatctgcaactctgttaggatcgtgaaggaccaagctggcgcaagtgttttccgctttgtgccagaagagagtgtggaatggggtgaagccctaacgtgaaggtcaagaagaatgctgtggcctggtggttccagagagaggctgacctgcccctcccatggcccccacttgggcaaatgttgccttgtgggagcagctggtttccttggcccctcaggagctggggaagcctgaacagatgcatttctccctctgatagggtgagaatgccatctaagaaaaccaaatagtagagatgttggtcccaggaatctaacacgatttcccgctctttcttaaagcacctcaggaaaacaacaaatttaatggcacccagaattcaggaagtgggataagatgtaaaagaaatagactaagaagcttgtaatgaaaatgaacaatggagataagagaagacaacctgaaccaaaataaaacattgtaactaaagcatgtgcagaaatcccagaatgataacaacaaaaaagcaacaacaacaaaacaaacaatggccaccaaatgctggagaaaaaattaaaatcataatttacaaactaaaaatggcagcagattagttgaagaagagaggttaatggttttgaagaccaggtagaagaaacaactcaaaacagaaaagagaatttcagataaaattaagaagacaacaccatgcacacacacaaactgaggcacattctagaaaaattctttaacttcaaggataaagagcgtttacaaggtgccacagagaaaaggcaggttacttttttttacttactaaaaataaataacaccaataatgaatttctcatctgcaacaataaaagcttgaaaacagtggaataacacctactgagagaaaaaaaaaatgcaacccagggatcttatttgcagagaagatactgtaggagaggaaagatttcttttcccatgcgtcactagttcatgactaaggcccctataacaaaagacagattaacaagagaaatgcacacaaattcatgtaatgtaagttttcggtgacacaagaacctttataaggaaatgaatgcccaaagaaacaggtaaacttgtgtttttttgtgtgaggttggatgaagaggggacagtcatggggaagtgtgattgaacacagggattgaatggtgataaactgggaggaactgggcaaggtctgctcgttcagattcttctctgtgtccttgtgtcttcagagatacggctgttgcttcctcctcgtatagggagggcacctcttggatgagggtcttatgtcctgcttcaggggagaaggtcaaggggaaagtgagagtggccttcctgcttctgctgttttctcaaatgccaagtgccatgttttgggtagcatgtcctgaaccccatcaatagcatttatctctcagagtaaatgaaagatacttaggtaatgctgggattcagagaccacgtcaacagtgtacacacaccgtctaaggaagtactcaagaagaaataccaactgaattagaatcatggcctccgaagaggagacaatgatgagaaagcaactctacagtgtatatagttaaatctcaaacgatgattacagagcaactggaaatgtgtcagaagcactacaagagaaaccttaacagaaggctggaactaaaagcatttacctatctcagcaaaatccagcagttggaggaaagtagaaaagtaaaagtgttccaaattctcatctcatctgaagagggagagtggggaaacagttatgaaatagagctttagtggagggaaataattgctatcttgcatacatatgacaatgacaaacatatatttgaatatgaatgtcaggagtgggaaggtaatcattaatacaatgaaaagaggacaatagacccacctaattagcagtgaggaaagggattgactagcagtctgaccaatttagcaaaaacagctccaaggaaaaaaaggcaacaggaaaaatcatgaataatcaaaaaacaagatgaaaggagtcaaatctactctattacctatcacctaaaatttaaatgtactgcattttggccgggtgcggtggcttacacctgtaatcccagcactttgggaggccgaggtggatggatcacttgaggccaggagtgcaagaccagcctggccaacatgcagaaacccggtctctactaaaaatacaaaagttagccaggtgtggtggcaggagcctgtggtcccagctactcaggaggctaaggcacaagaagcgcttgaacccttgagatggaggttgtggtgagccaagatcaatgccactgcactccagcctgggtgacagagtgagctctgtctccaaaaaataaaataaatacatgtactgcattttgacataaactactcaattgtttcataaaagttattggtatttttaagacatacacttaaaatggtaaagaaaatggttgagaataaagatatattaggtgaatacaaacaaaaagaaaggaggaatggcagtattaatatcaggaaagatggaatttatgatgaaaaactctcagtaggataaaaaggaccactgggtaagtgatgaaaggcatactgtgcagaagaagaacattcttaaaatgcgtaccttaaacaataatatagtagctaaatttataagcaaaaactattaaaaaaagaaagattgttaaaacacgttagtagtgagatattttgattcacttcttttagaatcaggcagatctgaaagacaaaaataagacagcaattacataatattaatcgaaaatttcagctaaggtatatatacagaaatttataactgtcagaaatgatacaattttttatatttctataggatagttgcagaaactgattatgtatttggccatctaaagaaacattaaaaattcagaaaatagattttataagccaaaacattttatcataaaatgtagtaaaattagaaataaataacaaaaagataattagaaataaataacaaaaagataaatgaagaaaagcacttttgccccttggattatgatgtcccttgactgtgatgaaaagcaatcaagagcaatgaaaattctacttccaaaatgtatgggagacagtgaaagtcataatcatagggaaaacattgtgaagaaatcaggaacaaagactaacaaaataggaatatactatatatttaagaaatgagttcaagccaggcacagtggctcacgcctgtaatcccagcactttgggaggccgaggcgggcagatcagctgaagtcaggagttcgagaccagcctggccaacatggagaaacccccatctctactaaaaattcaaaaactagctgggcgtggtggtgggcgcctgtaatcccagctacttgggaggctggggcaggagaatggcgtgaacccgggaggtggaggttgcagtgagccaagatcacgccactgcactcaagcctgggcgacagagcaagactccatctcaaaaaaagaaaaaagaaaaaaaaaaaaagacaagaaatgagtagagtacaatgtctggaaaataaatcagaggaagtaggaagaggtacataagatataactgaaatttaaaacagacaaaacagctaagtctttaaaaaggctagtaaaatagaaagcacctatgatcctgattaagaaataatgagaacaaaaataagacatcctaaaaagactgtaacaactaagaggtgctattattccaagcaataaatttgaaaaatctagaggaatttattttttctcagaaaatatgagtaaccccaaaagatttcagaagatggagcaaacttgtcaacaccaattatttcagacaagatgagaaaggtgattaaaagagagaccatttccaagggccagatatgttcctaggtacattttgcataaccttcaaagtacaactaagtttaatgtttaaaaatctattcaacaccacccttcataacagatggaaggcatcaaagttcatgttatgaagttggcatgaccttaataactaaacttgattagagtagtacaaaaaaagaaatcatacataaattgcttcacctaccaaaactgcttttcagtaggtgtgtaaaaattcaaaacaagtatttgcatttaagaatccagcaatatataaaaagaataatatgctagaccaaattaatagccaagtggttactaatccttgctgaatatacaaggatttttcagtgttcagaaatctactaacataattagattaataaatcaaaggggaaaaccatgatcttatcaatagatgatttacacgttttggaaaaaatttagaaaggattctttattcaaataaactcacaagaagaaaaaacacttcaatatggtagtaatatttgacatgatcactctagacactaaacagcattctaaaaactgagattctaggacatttcagttgaaataggaacataagaaaggtttacctattctcacaattattattcaaaattgttttagatgttttagcaattgtaataagaaaattaaatgatatatattttggaaaaagttaaaatcagtacttttgttaaagatatggttgtatgcatacaaaaaccatgtgtctctagaaattaaaaaaaaggaatttgaagtgaatttggtatttggatgaatacaaaataaatatatggacagtgtagatcatatagtataacggttgagagtataggttctgaatccacatgacctgtgtgtgaatcccaggtctgccttgccgtagctgactggcagtttacctaatcttggccaaggaacttttttggacaagttacataatttctctatgcctccattttcattattcatagattgtgctgtagtttgttgaggataaaatgagttaatatatgtaaactgtttagaataatgcctgatacctgttattaatatctactgcttggaagtcagaaaaaaaaatcctatcacaaaggcaacagacactataaaattctttggaataaattttgcaagcatgctatgtgacctaatgtgagggtacctataaaatattatttaaaaaacgtaaaacaggacctaaataaataatcaatgtttttggatgggaagatgataccataagaatattaattctccccaaattaatgcatagaagttaaggatatcaaatagaattccggtgggttagagttaattttaattggcgtgagtgatcttcaaatttatcttaaaattcaagtgatcataaaattcgtattttcaaatttctggaaatagccgaaaccatatttaaaagtcaaatagtgaggacaaaatggagttaatatgtattttcaaaagtatgatgaagctgctgtaatcatgtctatatgatattggcataaataaagacaagtagattcatggaatagacaaaaacttcagaaatatatcctagtatataggtaaatttaacataaaacaaaaaaaaggtttttctattcagtgggatttgataaatggtgctggcacaactggttatccatctggaagaatataaaattggacccatatctctcagcatattcaaaaataaattaagatggattaaagacaaatgtaaaaaataaagcaagaattctagaagttaatttgggagactaagataggaatgacttgagccatgagtagcagaaagcttcagcttaaaaactgaagagaatcattttcttataaaacacgaagtccagagatagactatctagccagggcgtaaagatatcattaaggcatctctctatctttttcatctttgtcattcttagccggtagcttttgtccccttggtgcccaggtggcagctgtgctttcatattcctgttggagtaagaatgaacgcacaggtaggaaggccttctctactttggactagttcattttactcccctgaaacttctcgctacccctctcttttcagagctgttatacttgaccatacttagctgcacaagaagacaaagcggccgggcgcggtggctcacgcctgtaatcccagcactttgggaggctgaggcgggcggatcacgaggtcaggagatcgagaccatcctgtgaatggtgaaaccccgtctctactaaaaatacaaaaaattagccgggcgcggtggcaggcgcctgtagtcccagctgctcgggaggctgaggcaggagaatggcgtgaacccgggaggcggagcttgcagtgagccgagatcgcgccaccgcactccagcctgggcgacagagcgagactccgcctcaaaaaaaaaaaaaaaaaaaaaaaaagacgaagcatttgccatttttgctttccagtccttataataaaggtggcaagaagaaagtggtttgaatccacacagccgatcccagggactcaatagtaggggagaaattttgcaatagaaaattagaatgtttctaacagaaaacccagaagaaaagatagacttaaatgattagttttaaaatttaaaaccttttacatgtaaattaaaatacccagaaacaaaatcactacattgggaaatatgtttataattcttatgacatatataatgtctatatctataatatactgaatgactgttacagtttgaaaacagaaagataaacagcccaatgggaaatggcatgcatagacaattcacaaaagagaaattcacacggtcagtaaacgtgaaaaggagaatcgatgttcctattagtgtgggaaaggcggtagctaatcccaaattctacatccctactatacagcccctatcctggcatccttcattgagcattcatatatccagggaatatgcctaggaagtttctccccacttggtaagcaggaaatcaatggaagcggctactgtaggcgggatcttcctcattggtacatttgttcaaagagacagtctcacacatggaagccatgccctagagtacaattcatccagttcttcattcagacacagataactcagaagacctgtgtgttccatcttggcatcctccatgttgttttcatgggaaaatgcatactgattcttatcaacttctaaacccaacaaattcctaaagtgagaactttctatatagtttttgaagttctggcttaggaagaagccaaaaaaaaaaagcaattcatgaatagctgtgctcaaaactttacacagaagctctcattatagtgtgtgaaataaacaataacacaaaaaactgaaagaaaaaaactgcaaaatattcacagagggtgcatttgagagtggggctgtgaaggaacaccttctgattttcagtcaaaaggtcaaaggccaaaaataattcctgcttcggaactgcagcaggttggttctaccctttgggggttggagaagaaaagcacctttccagatggccagatctagcttgttaatgtccctgctgccctgatggcttggttttcaattcagggtgaacttcagatatggtgtttaagggaggagccagataagaacatagcattgtgcttttgatttattttagggatgaaatgtaaaccaaaagtccccaatgctgaaggaaattttaactttttcttttccatttttctccttggactgttgatgctattattcttagcttttttttttttttttttcttgtgttccattgtgctgccttttttctgcctctgcataaactgatatggttgggagatctttgagagcctctgagtccactgtatacatgaggaatatgagactcaaacttgttaaagtgttcactcagacaacagctggtgagttctaggtccagaagaaaactacaatcaaatttcaatcatttttctacactactcttttatctttctagtttctattagaaaaccgcagtaaaaagctacgtatgttcttaaatatcttcacaaatgtgagatagacaaagatatcttagaaaggtcctaagtggaataaatataaaagaaaaaaattgataaattggacttcatcaaaattacaaagttttgcttatcagacattacctttaagaaaatgaaaagcaaatccacaatctgggagaaaattatctatctatcacagagacttgtctctagaatatataaagagcttctacaaatcaacaacaaaagataaataaccaaattttaaaatgggcaaaaaacttttaatagaaacatcacagaaaagagacacaagtgactaataagcctgtggaaaatgctcagcaccgttagccatcagagaaatgaaaattaaaaccacaatgaaatactaccactcatcttccagaatggctaaaattaaaaaagacccatagcaccaaatattgaggatgtggaacaactgaaactttcatatgtaaaatgacacaactgctttggaaactgttgggcaatttcttatataaagttaaaaataacatctcccactggacccagcaattcatctccttagtatttacccaaagtaaataaaaacttaagttcatagcagctttattcataataggcccatattggaatcaccaagagaatggatataacaattgtatgttaatacaatagaatatgagttggcaacacaaaagagtgatctacagatacttgcaacaatgtggaagaatcttaaatatccactgagcaaaaggatcctgagtacatcctgtatgactccatttatataaggttcaagaacatacaaaactaaccttctgtagaagaaatcaggacagtggttgcctgttgggtggggattgactgggtacgggagagctttgtgggagtgatcttatcttgcttggggtcatggtgggtacatttgttaaaactcatggaagtatccactttagatctatgtatgtcactgcctatgaaatttacctaaatattaataaatacaacagaagcaaaaatcagcatgttcaaacaactgtagttgaacatggaaagttttgggtttgtattttcccggcttccacaggggtaagatttgatttggtgccaagagcagagttgcactgtctctactgaaccataaccacaatctttcaaaaacaacctccgctgtcatcgcactataatgttttgctggataaaggcattttgcccattaagataataacatatacaacatatccaggactgcactgagagaataaagagtttgtgtcatagatgggaccagatcttcaaatattttcatctgtttccaaataaaaaagagcctgttttaagctcttagatatagactacttattttgggggagggggaggcagttttattagaatattactaaaatgataagtggtttttaaatgtttctttatattgtatgttctggctaggtcaaaagaattgaaatcatatttcttaaatatataacatgaaagttgtacatataattttagaatgtcactggtagcattggacagatataaaaatagtgtcagtaactcctttgattaaaataataatgtctctgcaccattttatcctgctttggatgtgaaatggaataaattatttttgttactcttcttatttttattttatttatttgtattttttttgcattatgaaaatctattaaccattcagacatgttggaaattgtgaaagaggaagatttgagagccaagaggaaaatgcttttaattttaaagactgagatttagtttagtcttggatgccattatagtgaataatgggaactgatccgagacttcaaaagaaatatgaccatatggtcctaccattcagtacttaatgctgccatgaatttccagttagaccccaaacttttcatttccccagtgttccccctcacctctgtcatcagacaaaaacgaaaggaatctgaaaccccttttcatgttttctgaaatactggtgctgagaaagcttatttttgtgagaattgagttttatgaaaaaagacaaaaacctgaaacattaatcagatccactgggctaattactgcaactccaaagtttattacttttaaatattaactgcttaaaatgattcatttagagatcaaaatgattaatccttctcagtcactataaatgtcagcggcaggattaaaggatttagatggtcatgtttactcaaccttacatttctgtacttaaagacacaagttaaatagctctagtttatcattgtttcatgttaatggttttcctcttagctccctcttttagctcccctgcctaactgattgttaactaattttggctgttaagtaggcaagggcttctttcaggctcggcagccaacctgctttgtggattacccaccagaaggtgtgagtagatagatgtagcttacagccctcctcaggacgcagtgggggtaatcctttccccctgcctcggccttcattggtctgatgtgttgagccccagcttactgctcaacttgtatctggttccttgccacgttgcccattttggatccacagtgtgactcaccgcggtgctgcttcagtcgcaattattaaacacctgccgctttatgccaaaccataggcgtatttataccaatacctactgcagttcgactatcagatatcagcagatacattgcaggcgtattatcattgccgggccttggattgttctaaagaagtcatttctaagtaaacataagaagcaaatttattttcagaatgtttttgatttaaaaaaaaaagctattttaaagttatttcttaattacaaatgtttgctaaagctttttttatggttgccccattaaatccttcatttccagacctaagacatgctctttctttatacgtcagccaactcacaacctaatttttcttatttgggccaccaaaccttccattcaatatgcatatgttcgtcctcccctggaggcctcacaaattttatcttgaagaaaatgcatcttttctggggccattcattctagtcctggcttttcagcttgcagatatacctagggtttccctttcttacccacctcctcaagttcaccttagtgcccagcctggaatttccattgaaagctacatttgtgatgattgccgaggggatgtcctgcaatggcttccattagacttgtgttgtgagtcatcaattagattatgagtatggtgtccagtggtcattttcagcgtcctctggaaattcatgggtttcaatatgtggttatgggtattaacaacatattaatagataaatcaagtaagtagttgaaatggggtggggaccttaaggtatttagtgggattttaagttagtttcttaaacctgttttttgtagggccttatgaataaagatttgtagcctcactgaaatttctattgcatgttcaagaatgggtattttgttcaaatggtgacacatttaacataaaaggttaaagagtttggaatgtcccataaaatatgtatttggaaataaaattacatatacttcttttgctgtggaatcttcttacgattttgcaaatacagcaaaagagagaactctggaagacatggtggtgccactgattcaacaagcacctaataagaaatgctttcccagtttgtagttttgtgttctgcctgactgatggaggagagtcactccatgcctgagaagaaataattccattcaagctcacaacaaccaaggaaaataattaaagacagctatagattgttttatttatgtgcatttaatttatatttattcatccattttttcccatattcaattttggggttactgtaggagaaatgaatggttattctcctttaaaacaatccatatatgatgaagaaaaagggaaggattgaaatggaggggaaaatgctcccatgtatcttacaaagtttcatttctttacaataaacgaggaaggatttttaaaactgagcttcccctagaagaggcaataaattaaatttctaattattgagtagaagctattaaacagcaaatcaagaaaatatatttgttttttagaaagaagataggctttaattttttctttattatgtttttaaattattgaaataattatcatgagaagtaaaaattcaaaactataaaatagaaaattactaatttccttcatttacaaccttttctaaatgacccattataacagttatatatctccttcctcacctttattcagattcaacttatataacctgtgggtccttttccttaatttccaaaagtgggattatactatatacataattctacaacttgcattctttttctacttaaaatatatacaaacgagcttccctgcagatccgaagacatgggtccaactcattctttatgctaaccacagtgttccacagcatgggcatgcaacttttccagccattctctttctggccaacatttgggttatttaaaattttgcaacaatgctgtagtaaacaacttgtttaaataaacattctgtatatttaagatcaggtgattttatttctataggatatagttccaaaggtagatttcctatgctaaataatatttctgattttaatagaaaaatattttacatggagtgaaagcagcataatagaaggcaaagaaaaaaatgatagaataaaataataaatttgcatagcagactcacagaatcagctgcttttcaggggaacaatgattcttgtttgccctctaaatttcaataccaatgacctatattttaagccctcattgcgaactccaagtcccacataaagtgtggtataaaagagaaccaatagatgataacaagtgttcatgagcctgtgcagaattaaaaccctcatacactgctagtgggaatataaaacactgcagtcattgtggaaaacagtccggcagtgcctcaaaaggttcaatacagagttaccatataccccagcagttcctcttctaggatatgctcaagagaaatgaagacatatgtacgcatgaaaacttgtacaggaatgttcctggaagcattctcataatagtaaaaaagatagagataactcaaatgtccattaactgatgaatggataaatgatagtgtgtccatacaatggaatattattcagccataaacaggaatggagtactgatgcatgctatgacatggaagaactttgaaaacattattctaagtgaaagaagccagtcacacaagaccacatattgtggatcttctttatttgaaatgtccaggaagggaagtagatgagtggttgcctagggctgggggtgggaggggtgaggggaaaatagaaggtagctgataattggtataaggtgtctttttagggtgataaaaatgttctaaaattaattgtgcccatagttgcagaactctgaatatactgaaaaccattaaagtgtacacttcaagtgggtgcattttgtggtatgtgagttatgtttcaataaaactgtttgtttttttaaaggaacaaacaagcaagagaccaagagagaaggagagaaagccaaatctagatattagagaaatccagacattagtgaggagagaatgccttccccgtggggtgctttcgtcatcctatgtacctctgagactagtccctcgggtagaatctgtttctcatacaagagatagtagatgtgttacccattggtgaacatcaccctgattgtggctttgaaaaatccctcactgctccaactaggttatagacaaatagaacaaatttctatgagaaaaagaacaaatagctaacccattttcccaatctccttcttttattaaagagggagctgtgctatgtgccaatctcatttgaaatatttgtccttacaccatcctttctactttgtcaaataccctcactcgttttttaaaacgtgaacctaaaaaaaatgatgcagcccacctaggttgtgtttattcagttttccttttctagattttcacatttatgagtgtcataaaacaaaaatgcctaatataatccgagctaaccttgccttttaatcacagtgaattccatcctcaggtgtactttgttcttgctacaatttattgttttggtcctgtttcaaattgtaatgggaaactcttgttggctctgctgatcaaggttaccaaaattcaatgtacaggagataaatacttattttgccagttatggccaagcagaattaatataaagaccgtaaaaggcaaagaaagaaattaaagcaatgttagaactactgcaaagaacatggcttttccaatgtaaagaaaacatggaaaatgagaataaagtattgttccttgaagccaaagctgactttacataggattgtccagggttcagcctggtcccaggggcatctcagctgccttgtcctgcctcttcccacttctctgcactgccataaagccctccccactactacaagcccagcccagcccagcccagccctcccgccctcctccacaccgcttgtcgcagtcagggagctctattctctccatcttccctgcactggtcaaaactgcagatgttttccatcagcatagtgtatcttgctaaacactgctagattgcaagaaataatcgaatagactaatttattctagtttaaggttagatctttccaggggtgtttgcattaaaataagggatcctaaaaataaaaatttcttaaccactgaggagaagtgacaacaatagaatgtgaagcactgagggaggtctggagcagggatgtttttgaataaaggcaattacttaagtaaaactcaactttggtggtggtgttgctatttgaaaatgagttgaaaatgatcctctccctactctcaaactatacacttctctgtgattattaattacgtttgtcaaggtatttattttttaagtgatttttttcatttagcccttttttgtgtgagtcacatttacataaaccatctcctaaaccaagtcaggacagccctgaaagatgaaaaaatagagtgtaaagtgacttaaacagagctagtgagtggctttaacctgagtccaactgaggccaagtttagttttctctcctaggggaaactaaaacaaactttttaattcagtaaggaaatctaacagggactcctgctatggtgcttgcatcatagcttcatttcagaagcagccctggagaattttgaatcattgtaagacattgacttcagagggaagtcgatggagggaagtatttatggagtttgggatacgtatatcaattcatagggatgatgtgttgtgtttttagttgcaaagtgaactgtgtttacatacctgggtaacaaagattacagttttctgcttccttcacctcatagattttttgcatcaagatggcaatagtgtgaaaagccaatcacttggaaattgtttcaagccacattgtagagattagaaagagagttgttactggccttttatttctcttttcatttctgaatgtgggcacctctcaaaatagaggcaaaaaacaaaggatcttatttatttttccctctttaaaaattattttgcatccttattttgaaaaatcagcatgtttgatggcaatatctacacgttttagagtcctcccgtatgttacaagtgacatataaatagcagtgggtaagctcttccacagcaattccattaactgttcatgtggacactgaccttgttcagatttacttttataagtacaatctgcagtaatgattttaacatgctaacaatactgagtctcatctcagtgagcttgcctgccttctcactgttcaacgcacaggcgctttttcctttttttctcttcttttactcttcttttgacatactttttggttcagatacgtgttcacatctctctgataagcacactttgatttgcagctaattgtagcaactgattttcattatttatgagtgtcattgtcggaatccatttggaagtctgaccgagataaagctgattccaacttctgatatgaccacagcaataaagcaattaaccacactagttaaaatgtgtggcagcctggagggtgctaatatctttacaacccaatatttactacattgtccattaggtttgatttatttccgagaagattcaacatggtatcattttatcacaaataatttataataccctctttcaaaaaatataatgtatgtttctcatatcaacctattagcattaaaatgttcacagatttaagaggtagaagtagggaaatcaaaactatgagtaatataaatgcttaatatacttaaaaggtttggttatgagatagcagcatttaaatcagtctttgtaggttactattctttacctatattttgattctgattggcacctaaatctcacactctaccatgtcaaccagagacaagaaatagaaaagctttatgtatgcatgacaagcaaacatttttctcactcttctcatccatagtagtataaaacgtgaaatttccagaataaatacaggattggaaaagtcattaataacagcagtcattttaaagtgtcacctaatttaaacacttttgctttaagttattgcagtgtcatgagttttattatgctcaatttattagtaaaggcctgcagagttcacagccatttatttttcagggaacttgattttatcattaatttttaaatacgtaatactcccactttatttttagagtgcactttatttgcaaagattggtttactctgatcaatacagatgttttcaggtgtgtagtaaagcaaaaagcctagaaagtcaaaaatgtacaaaatatgcagcaaattttttagacgttatactccaacatttaatgtgtatatacacccaccccacacacacacatatatacatacatacatacatacatacatacatacatacatacaaaatactacgtgttatgttgattgctaagtcaaggcggaaaaatataagaagaatgaccaagctcctgtttctactgtttgagtaacttattcttgaagggaaacttttctcttccaaaggagtgacatctgggtgggaaaattttattgttggggactcgagccaggacacagaaaataattctgacaatttccattgcctcacaagtctgctaaacaaaattctatcattgcactaatcctttctctgggttgagttctcatggttggggccactttacttgcccatctctctggaggtacttatgggcttaaagagttgacaaaggagctctaagttggggccccgccctcctcccataattgcgcccacttgatcctatgccgtgtgacgctactgtaaacgcctggtgctgatcgctgaaaagcctaaatgtttgagtgtttatttctgaaagacattcttaaaaaaaaaaaaaagaaaagaaactaacactgaacatatactcactagttgttatctttttttccccctaattaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatggtaagtttcctttttggctttataatgttggcattcagtgcttctgtctgttttggttgactccgcggggggggatgtttttctttctctccttcctctcatccttctttctctctctttcttgtccatttctttttgttttaatgtagtagaactcaagaaatgtccttgaataatgcattttttcctggaaaaaaaaatcaatatttgacatcagattgttaaattaggcaagcagtctacaatgttttggctatagttttgaaaaacaggttaatcatctacagaaaaaaaaaatagctttgacttctcttggaccatgtcacctgttgtcttctgtggggtggcaaagcacgtgttgataaagtttaccccagagccgtcttgcaatcaaagatgtctttgtagattcctcttgaagatatctcaaagaagttgcaaaatcttagaatggatgagtgagcacgcagaatagtttattaacagggctctagtgattgaagaacaaatatgatcatgctttaaacttaagagttgatgagagcaattgaaatcttggtaaagagggggagtgtggcctttaatgttctttggggactggattactaagcaattaaatccacacacaaaaattggattttaggatatccaaatagcagctttttgtatattgtaagaaaaaaagtctttataaattattgggactttttttttcctattgccaatgcgggatgattttttaaaagttaatttatatgcaataatacattttaaagaaaacttaatttttagtcagtgctgcttctaggaagaattggggcatcagcagcaatgcagcaaacaaaaaattctccttccgcttttaatattaacagtgcacttgctatttcagtctagttattaatgctatgcatatcctatgcatcaaaaagcaaagagaaaattaaaatgaaagaattgcatgacatttgaaaagaaaaatggttgttttatcaatgatatttcaattttattatttattgggtgactttgtcagctttgctttgtaataggaaagcggatctattgttagctttcagtttcagctaagtcacagtgtgaagcagcacctaaggcttattagttattttctttctattcatgaaaaaaggtctaatttaaaccaatgcaatcaatttcttatcctaagtagaatatcttagtgcattaaaccaaagtcaagatcaaataatagctatatactcaatatcttcatttggaagtttcagttcttggtggaggctggctttattccaattcaaaagaagaaacaaggacagttattttgataaaatgagcctcagaatcaggatgccaacatttctctcagttaatccattcacctcagtaaatcctgtgtttctatccattttcatagtggattcagaagtcactaaccttaaatacgtatgatttggaataaatattgcttcctgtccagctgtacttcacatagcactccttgagcaatggcaggtaccatggtcatattcaaaggtagcacccagcatttaattttcttaaaatacacaataaaatctttgacgttatagaagactagaatgcagcaggataatgcgatcagttctgattatctgcatcatagatcatccacatccatagctatcaaatatgttttaacattgggtcagtgtgcactttccaaacaaaccttctatggcatctcatcctttctctctaataacaaaggtgtcttgttatggtatctgtattggtaaaatataaattaattttatgatttttaaaattatacatctgctaaaaggatctcatggtggatccccaaacatatgtatttttttttctttttggaaaatataaactttgtaacctttagttaacgacacataatatccaaatgttagggagaagggaaggaagacttgtgagtttctcataccactgccctcaccattcgcatggattaatattaactagaggaggaaattgtttccccaggaatcttgtagaccttgttcttagagtgatgtaaaggcaagaaaagttgcactctttaatttctccaagtagtggctaggaagcagaatgaagagagacagggagagtgtcaagggccttgccttgaaattcagaacatttggcagcatttgttgagagtaaataggtcagccaagttaagagtataaagtgtcaaaagcaatgtttgttgagctgggcaacatgatgacttaaacttgtgtttactctttttccgaaggtttggttgtggttgtacttttaaacaacgttttgatggtctaagaattccaaatgagagcagtttaaagaaagaaacaaaagaggaaataaaatagatacgttgtcttaatgaatactggctattgcatatatttcaaacatatgtccataggaacttttcagattaatttatttgttctgaaatttcagcgattacttagaaggaacaagatttcatttaatgtaattaattacattaagatatagggaagcataattttctgaagtatttagcagaccttataattttgaattgtggaattaaacaatagcactgaggatttttttcctgatattaaaaaattatgtgtctttcccttaagctgggttatagtaagaagtgaaatttgcagtcatacataggttcttctaacaactttataaataatcgtctcaaaactaattcacatttttacctatattactacttttagtcaagtaattctaatataaagttaacaaaaataattcaattctactatcttcaggtgtttttaattgctctaacttaaaaagctatagattttctggttatattttcttttgactcttcaattcttttcattttctcttttattcatttttatactagcttgagatgtgttcttggaagttctattgtatcactaaaggttgaaaagagaaggagatggatgaaataactcaccaaaaggaaacgaatttaagagccagatgctgatgtgttttcatctggtttaacatgagagcttgccttgactgttttcttcatttgaaataactgtgaatgaggctgtttttcccagaaaaaaaaaaatgttattcaacattgtaaaattatgcaagcagagtgcctgatgttctagctacaatttcaaagaagaatttagtcactaaaagggattagattccatttatttattgataaagaggccaacagttcaagttaagaaggtgctagaactgctgtgaggctaatgaaattttgatggcccgagcctcccacaagagtaagagaacattcggaccgtgtcacacagctctctgttagctgagagtcaaaacaagtgataagatttattcttttgcaaaactaacttttcaccagccatggggagttgacattaaaaagcattttgaggaaaaaaatattttacagtatatattgagtttcctgtgtaatcccaaatattaatcttgttccaaatgaaggatatgggagaagccctttcttggcacccattgattgttgtggtggtgtttttgtagtggactgccacacaccagggcaagttctggagagacggtgatttgggatcacctactaacagcagtttgagtaaaaatgggtgaaaggttataaaatcagtgtgatgggataccccagtaaaaggtagaattctcagtgtgctctggtttattgtaggcatctctcctgtctccaatgtggtttttgttttgttttgttttgttttttgagacagtcttgctctgtcgcccaggctggagtgcagtggcgtaatctcagctcactgcaacctctgcctcctgggttcaagccattctcctgcctcagcctcctgagtagctgggattacaggtgcacaacaccacgcccagctaatttttgtatttttagtagagacggggtttcaccatgttggccaggatggtctcaatctcttgacctcgtgatctgcccgcctctgcctcccaaagtgctgggattacaggcatgagccaccgcgcccggccactgacgtgttgttaaaagagccgtgactgaagtcccaccacccagctttgcaagtgctataatctgacctcagttccaaatacctatttaaacgtcaggaacaaagggcttttttttattttttcaaaacatcagtctttaagctttaaaaatgtttccatggagagtaactcagtgtcaagagatgtgcagaaaatccaaagaagggtaaggttgcccctggtatcaaggaaataagaaccagaagtcatcaggacagtgaagatatttagcaaagaaatgtaagtgggaaaacatgtaataaagttagttttgtgatttaataaataaataaaatgtttgcgtatgcatcgcttcccagaagcagccaggcatctattgttttttgtcatccagccggtgcgacgttgtcacaggtgcctggatttggaatcacactggtcagggctcacattctttcattcatcccctgtgacagttaccccctgaatcacctagagtggcagttgtcaactcttgcatgccttgtctgctccttcagctgcctgccgagttctggaggggcggagctctcctgttggagtctagttccttcttccagcctcctcagcctgttagccctcttggagaaagatgacctttgatgtaaggcaggccagcaggcgttggcgctgctcttccacctcctcgtgactcaggaccccgagagcctccattgaggacagtctttgcgaatgtgatgcccggaggcgggactcctggttttgtatgggcactaccacctcccgactttgagaccttgggcaagttgctcaccattccgtgccatggtttccacgttgtaaaacagggacagcagtaaacagggctctagtcctatgaggtcagggctgttgtgagcattaagtgagttcaggtatgcctggtgcttacaaaactccctgacatctagtgagttccgaataagtgtgtgcccttattattatttgtaaaaggtggaaaattatatctgtttatgtggctatgaagattaagttaaataaacaatatcaagtgcctacctagtttggactaggtagatatctatagatatcaatagatatctcctcctcccctcccccactcctccttccttaccccaccccaccccagggctgcattcatcaagtgttctggcaagatggaggagaactcacggtgtcttccagaaagggcgctgatcatttgtgcagtctggaatttctgtcaccatttattgactctcttatttttctccaaaaccccacatcccttttaatttactgtaattaaatgaatgtacattgaatggtgctgataattagtctgatggttgtagacttcaaagattttagcatgctccttcccctcctggccaaagaaaatttcaaaattagtgtttccctcaaaggcatgttacttagacagctggtcaattaacaggcaatttaactgatgctcatcagttcacacaataaaataaatcattccaagaagacttcatttctcacctaagtttgagcaatgtacctgttgtcggaccccactaatgccacattaattgtgcatgatactgaagtattatgggctaatttggctaatgaaaaagggtataacattaaagtgcagtctttttaaatgtaatagacactttgcacagctgaaacacttttcaaggaaccaatttcacttgtcctttgaaatggtattttaagtctactttctgtatggagagataaagtctaaaagttgcattattgtattttaagaggaaaaaggcgtacccctcaaaccaatttgataaatgactgtagtgatagcatttccatcaatctctaaagagagaacttcagctattttgcaatccagattttcttgtcaagcagaatatgttatctggaaaggagggcagtgccatttcttctcttcctgaacaactgcagataggtgagagagtgaggaaatagacggacttgtagctcttccagtgctgatcaaattctaggagagtttgagagaaactgctagccagctatgtcatgtacttgcgatcattctaggacaacacaaatgccacatctctcctagatctttggaggaaggggtactgtcttagaattctgaagatgatttgaagagaggtgtactttttcacctcactagcattattccattccttcagctttatccaggaaccttttctgagcctactttggttgttgattgaaagacataaaatggaattctgttgctgtaagaaacacatggcatttcagtgttattctaattttatgagtttctattatacatactaaactatagcttgaatataaatttcactgtgggccctcttccggcatgtaatggtcatttctggcatggtctcctgtgataaattatattttatgttttatgtgcactagaatgtcaaaaatagcaaacgtaatatgtcggtgggcttcctaaatcaggctcagaattaaagtgctgctttacaaaatgccgtcaaatagttcctgatatataaaaataactacattgccttgatagatatacatttacaatttcaatagtgacttgtcattctttgagcaaaagcttccctgtttcatttaaggatgaaatagattcacttcatgggtatgtacaagtcactttttagtataataagttatgatttaactggctgggcgtggtggctcacgcctgtaatcccagcactttgggaggccaaggcgggtggatcacaatgtcaggagtttgagaccagcctggccaacatggtgaaaccccatctctactaaaaatacaaaaattagctgggcatggtggcagatgcctgtaatcccagctactcgggaggctgatgcagagaatggcttgaacccaggaggtggaggttgcagtgagccgagatcgtgccactgcactccagcctgggcaacaacagggatactccagctggaaaaaaaaaaaaaaagttacgatttaaataaaatcctaaaaaatttagtattatgaaactagaactgaaacaactgtaaagttcactactgttgttgttactacaggcttaagtatttatatacattcatatttttctgttctaagaggattttcagaaagcttggcagtttgctatgcttcacatggaaattgccatttctattaagctcgatttgtgttctaagtgtttttgttaaagtatacagaatatatgccatctctgtttcaattctaaatgttcttttagttgtagagttgaaattaaagtgaagcatgctatgaatgtaccaaaactgatgatgtatgctattttgatttttgaatgtgtttttgatatccttgaaaaatcacagtggtagcagtaaaattgttttaattaatgaattgaatagcagtgagtgctgaatcaggtttattgatgtaattatcactgaaatagaaaaaataagtgttagagccatagaaccttcgtttatttgccattccgtgagcactcaagtgtcggaaaagcagctaactgagggtttttttggtgttgtttaaagaatattcttctcaaatcataataattctgtttattaacattacatacacatataattttatacatgattatcttgtacattatttactgaatggtttgaatactaacttcagtatattgaaattttcttatatttatcagttgacgagatcgttttccataataaataggctgtacgcaaactaaacgtgaaacctatttgaatgcatgttaaaatggatagaaatgcgtatacacttaagaaaagagcaactaaaaatgtctgatgactattgccttgactttagtcacgcagaacctgaaaactaaataaagggtaacttattgaatagatttcttatttagtatatcaactaagtcttcattcaacgaatcataaatgctggatatggtaccaggtgctggaaaaacaaaaatgagtaagatgtattccctgacgtctagaagctcacagggtggttgggcaaaccggcaagtaggcgtgtaattaggttttaatgtggttagtgttattacaacagaatatgcagagtcagtgtcagcccagagccgattgttgccaacagagactgggggcaggagaggagagaatgtttcacaaagaaggaaggaagcagcgttggaccagaggcttaaaggatgtggagaaattcgagatttagacagaacagcaaaggagaatgtgtaacttccctggggatgctccaaaagccacaaggagtttgatgcctgggacacatgaggctacaaaagtagcccccgagcaaagtcttcatggtgatgctaagggatttgcacgttttcctgcaggtaatggggaggctctgagggattttaatgcagaggaatagtatggtcatgtttccgttttacagagtaccctgaaagcagtgtggaatattaactgtctttcctcaaggagagcaacctccctggggacatggccctgttcactgttgtacctctgtgctcacctcacctaatacctgaacctggaaataaaggttttgttgaatggaaaataattgacttagaggtcaaacttggaagcaaattggccagttagatagtattataattatcaacataggaaaatagaaaagtttggatcaaaaaccagaaaggaaagggagacccatttaagtagaatcaagatttgatgattaattgggggaagagaaacatttaaagagactgtcttccccaacatgagagactcagtgagtgatggtataatccaagttgaaagttaaagtattttgtctatggtaaagttagtaattcacatgagaagacatagtgtttgatgtgtctgtgggccatcaagtttcagtaatttattagccaattatatatatattatatatatatatatgaaattcaattagattttgtgtaaaaatatttactctgtgatctatattattgcagttaaagccacagggcagaattaaacctctttctgaaagcaaatagaatgagaaaagaagaggagtgaagctagaatcctaagctcaccaatatttaacataaggttatagatgaagcaccaataaaagaaacgaaggaccttttatagaggcaaaaaaaacccaaaagattaattgacaaaagacaacaaaagagacatactgtgatcagcagagtcaaaaacttccaaaagttgctgggtacagcaatacccgtgtctgtagtcccggcactcagaaaggaggctgaggtgagaggatggcttgagcccagaagttagagaccagcctgggaaacatagtgagaccccatctcagagaaaaagcttccagtgaggataatgtaggtatagtgggtgtggaagtcaaatcgtggtagttcagagtggaaccaaaaccttaaatgtggcaccagcaactggagattattctctccaaagctcaactaaggaaggagagagcgtggctgagggatccagggatggaggtacttgcataattggaggacatttcagcatcttcttaaggaaagggacggagcggcagaacaacaagaaggtggagtagaggcgattgagggaaaatgaaaagcgtctgacctctgagaatcaggagtgaaggggtccttggagtatgaatgtgggtaactgcgagtccctgaaaactttttttttaaatatatttttaaaattattatttttttattattattatactttaagttttagggtacatgtgcacaatgtgcaggttagctacatatgtatacatgtgccatgctggtgtgctgcacccactaactcgtcatctagcattaggtatatctcccaatgctctccctcctccctccccccaccccacaacagtccccagagtgtgatgttccccttcctgtgtccatgtgttctcattgttcaattctcacctatgagtgagaatatgcggtgtttggttttttgttcttgcaatagtttactgagaataatgatttccaatttcatccatgtccctacaaagcacatgaactcatcattttttatgactgcatagtattccatggtgtatatgtgccatattttcttaatccagtctatcgttgttggacatttgggttggttccaagtctttgctattgtgaacagtgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatgacatctcactgtggttttgatttgcatttctctgatggccagtgatggtggcattttttcatgtgttttttggctgcataaatgtcttcttttgagaagtgtctgttcatgtccttcgcccactttttgatggggttgtttgtttttttcttgtgaatttgtttgagttcattgtagattctggatattagccctttgtcagatgagtaggttgcgaaacttttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaagtctaacatttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtagatatgcggcgttatttctgagggctctgttctgttccattgatctatatctctgttttggtaccagtaccatgctgttttggttactgtaggcttgtagtagagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatcgataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaaggtggattcctaggtattttattctctttgaaacaattgtgaatgggagttccctcatgatttggctctctgtttgtctgttatcggtgtataagaatgcttgtgatttttgtagattgattttgtatcctgagactttgctgaggttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattaagagtttttagcgtgaagggttgttgaattttgtcaaaggcctttcctgcatctattgagataatcatgtggtttttgtctttggttctgtttatatgctggattacatttattgatttgcatatattgaaccagccttgcaccccagggatgaagcccacttgatcatggtggataagctttttgatgtgctgctggattcggtttgccggtattttattgaggatttttgcatcaatgttcatcaaggatattggtctaaacttctcttttttggttgtgtctctgcccggctttggtatcgggatgatgctggcctcataaaatgagttagggaggattctctctttttctattgattcgaatagtttcagaaggaatggtaccagttcctccttgcacctctgggagaattcggctgtgaatccatctggtcctggactctttttggttggtaagctattgattattgccacaatttcagctcctgttattggtctattcagagattcaacttcttcctggtttagtctagggagagtgtatgtgtcgaggaatttatccattttttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagcagtctatcaattttgttgattgtttcaaaaaaccagctcctggattcattaattttttgaagggttttttgtgtctctgtttccttcagttctgctctgattttagttatttcttgccttctgctagcttttgaatgtgtttggctcttacttttctagttcttttaattgtgatgttagggtgtcgattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccaatagtcattcaggagcaagttgttcagtttccatggagttgagcggttttgagtgagtttcttaatcctgagttctagtttgattgcactgtggtctgagagatagtttgttataatttgtgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtgttgggtgcatatatatttaggagagttagctcttcttgttgaattgatccctttaccattatgtaatggccttctttgtctcttttgatctttgttggtttaaagtctgttttatcagagactaggattgcaacccctgcctttttttcttttccatttgcttggtaggtcttcctccatccttttattttgaggctatgtgtgtctctgcatgtgagatgggtttcctgaatacaacacactgatgggtcttgactctttatccaatttgccagtctgtgtcttttaattggagcatttagtccatttacatttaaagttaatattgttatgtgtgaatttgaacctgtcattatgatgttagctggttattttgctcgttagttgatgcagtttcatcctagtctcgatggcctttacattttggcatgattttgcagtggctggtactagttgttcctttccatgtgtagtgcttccttcaggagctcttttagggcaggcctggtggtgacaaaatctcttagcatttgcttgtctgtaaagtattctatttctccttcacttatgaagcttagtttggctggatatgaaattctgggttgaaaattcttttctttaagaatgtttaatattggctcccattctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttcctgccttgctagattggggaagttctcctggataatgtcctgcagagtgttttccaacttggttccattctccccgtcactttcaggtacaccaatcagatgtagatttggtcttttcacatagtcccatatttcttggaggctttgttcgtttctctttattcttttttctctaaacttcccttcttgcttcatttcattcatttcatcttctatccctgataccctttcttccagttgatcgcatcggctcctgaggcttctgcattcttcacgtagttctcgagccttggctttcagctccatcagctcctttaagcacttctctgtattggttattctagttatacattcgtctaaatttttttcaaagtttttaacttctttacctttggtttgaatttcctcctgtagctcgtagtttgatcgtctgaagccttcttctctcaactcgtcaaagtcattctccgtccagctttgttccattgctggtgaggaactgcgttcctttggaggaggagaggtgctctgctttttagagtttccagtttttctgctctgttttttccccgtctttgtggttttatctacttttggtctttgatgatggtgatgtacagatgggtttttggtgtggatgtcctttctgtttgatagctttccttctgacagacaggaccctcagctgcaggtctgttggagtttgctagaggtccactccagaccctgtttgcctgggtatcagcagcggtgtctgcagaacagtggtttttcgtgaaccgcgaaagctgctgtctgatagttcctctggaagttttgtctcagaggagtacccggccgtttgaggtgttagtctgcccctactggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctctacccagttggagagcttcccggctgctttgtttacctaagcaagcctgggcaatggtggtcgcccctcccccagcctcactgccaccttgcagtttgatctcagactgctgtgctagcaatcagcgagactccatgggtgtaggaccctccgagccatgtgcgggatataatctcctggtgcgccgtttttttaagcccgtcggaaaagctcagtactcgggtgggagtgacccgattttccaggtgccgtctgtcacccctttctttgcctaggaaagggaactccatgaccccttgcacttcccgagtgaggcaatgcctcgccctgcttcggctcgcacacggtgcacgcacccactgacctgcgcccactgtctggcactccctagtgagatgaacctggtacctcagatggaaatgcagaaatcacccgtcttctgcatcgcttacgctgggagctgtagaccggagctgttcctattcggccatcttggctcctccctgaaaaacttttattttttaaggtacttttcatctcacaactttatatacataattaatttggtgtttgctatagaaaagtttttctgaaaaagatacctttctgtctaagattgattgaaatcataaccaattttaagtcagtgtagtataaattgataatatttgatggaactgagcgaccatgtcatcagaagctttggaggagcagtacattcttatccaaaattgacattttacttaaaatccttctataaaactgtgaaactggaattacacatccagattctaatggaaaacagttattagctttggagccagaactataggattgctgtcaggactagtccagggacataggtaacttctgatttcctctccttgatccttgatgtgagtatgtgatatttatatatattcatatagatgtgtgtgtatatatatatgagtgtgtgtacatattcatatatgtgtgtatgtatgtgtatatattgatatatgtgtgtatatatatgaatatgtatatgtatatattcatatatgtacatatatacatatatatgcatgtttatagtctttgcctgaggactaagttaatagctaggaaataagtttcctccttagtaactgccacatagttttgcactagcaatgttcttttgcttaaaaaaaaatgcatgtttataaacataaaattatataatcagatttaagtttttaatgaacactcgagacaaacattattttaaagaatatgtatacaaaaggtaaccataaaacctacttacaagtgatatatccaagagaaatagaaataggcctttaaaagccagagtgatagttattatttgcatattgcaaacttggaaagttatgactttgtgaaaaaatttttaagactaaactggctaatataaagtaatcagtgtgaagtatggttccccttccaactggttaatataggagtgttaatgttcacaaagaaagaacttaaaattttagcatacagcagatgaagattcctaggggatttgaaagtagttgaatgaaatatcagttgctacagaaaacaagtacaaaatattttcttgtaatggactgtgtctcatttattgtgactggagtaccattgtatagatggcagagtacaaaatatgcctataggtgaaccaaattatttaaatgaacccatttaaagagtttgtgctttcacataatcactggaatttttaaagcatctaatcattatttgtaatgtactgtcttaataccccaagtaaaatgatgggatacgacagatgtgataaaagtggaacctgagatcaaatgaacttaagaataaatcatttgagtgtttaaatcaatgcccttaagttatctatgatgtgatttaggatttcatgtttattgggcaacacagataagcagatggataataaacactagtttctcttttaggatttacacttttattcttaatctttgtgtgtgtatatttttaaaaaaataaacattgcaacttcagttgttttttgttttttgttttttgtttttgtttttttgagacggagtctcactctgtcacccaggctggaatgcagtggcgcgatctcggctcactgcaagctccgtcttccgggttcacgccattctcctgcctcagcctcccgagtagctgggactacgggcgcccaccaccacgcccggctaattttttgtattttgtttagtagagacggggtttcaccgtgtcagccaggatggtctcaacctcctgacctcgtgatccgctcgtctcggcctcccatagtgctggggttacaggcgtgagccaccgcgcccagccccaacttcagttttcacctaagtttccacatgctattggatttttttctataacatagtacttttttcatgccatgatttatcataatttaacatatctactactgttggacatccaggtttgaactttcgctactataagtgattctgcaataatgatctcagtggctaaatctttgcctctaattctgttattaccttaggataaattcttggaagtggaatttcagagccaaagggctatacaacctaaggcttttgatacactctgtcaaaagtgtgaaaaagcttgtatcaatttatactcccaacagtatacaaaagtgccttttcccccagggcactgacagggagtgtttccatgctttaaatttttgacaattggaccgatgaaacgtgtcttacctttgttgtaatttgtattcgtttgattagtgagttgaatacattttcacatgtatgtaccatttgtatttcttcttttgtgaattgccagttcttgcctctgtcccttattctgtgtggatgtatgaagaaatgggtcactcagggtataaggaaaactgaaggcagagatggacttcgaggacaccagcacagtgactctgctttttctcccttgtgtatatgtggcctcgatgagacaggtttggttgcaggaccttttgtatataaacatctccttacaagtgggccttctgctcatagacataggtgtaagtttcacaatggtgaagaacaggtgtacgtgagctggggcacaggcccaatgtgtggtcctaaagtctagctggatgccgcctgtacactttttactacagattctaggtgccaagaagttctgcatttactgcagttcagagtagcaagttcatttccacaaagtttctgtatccttattgagtaaatgaaaaacataaagcaggcgataaatagcactgggaggtaaatctcttttcatcaatccatagagtgttgcaaaagatgcaggagatacatagggatatagatacagtcctgtgccacttaactcatacgttcagagaaatgcatcgttggacaattttgtcattgtgtgaacatcatggtgtacctacacaaacatagagggtatagcccactatatctaggctacatggtatagcctgttgctcctaggctacaaatctgtacagcctgttactgtacagaataccgcaggcattcataacacaatggtatttgtgtatctacacctagaaaagatacaataaaagcatggtagtataatcttatggggctactgtcatatatgtggttcatcattgatcaaaacattattgtgtggtgtgtgactgtagagatatagatacagatatagataattatggacatggatttttttcttattaagttgcaaatagtttttatatattatgaatcttattaacccttaatctatttgtaaatatttagatcttaatattctgcaaatattttcctgtttgactttgtttaaggtatttttgatataaaggattttttttacaaactttaaaatataatcaaatcaatagcattatttacttgtggcctctcatgcttaaaaatactgatttcactctagagcaaatactaattatattttttctttatttatatgtacaaatataattatattttttcctcatttatatgtctacatccttacttaagtacatttactatatattatatagattacatttaattcatctgaattttgtaatgtaatagttgaagtaggaatttaatattttttcacattatccacttttgtaaatgtcatttaaattaactaggggatacttcatatcgtctaataaatatacgctaatctacttatatttcagcaatgagacatcaataaaaatttgtgcagtcaaatctttgcaaagaagtgggataggatttgtgaaatataataggtttaaatactaaattcagatttgatgatttctgatagacttagaatgctaactaaaaataaatattttcagaaatacacagccactaggagtgtaatgtgtaacctttagacactgtaaaaaaaatgtaatagtggaaaagcagacttaaagaagcttatggaagttacatttgatgtcagaagcagttatcaagatctatttttcagtaaaaataaagtgttaatcctgcagaaagtcaggttacataagcacataagcataacatttaatccctatattacgtattttgagagttcgttttaaggaataaaagacatcctttgctgtcaagcttataggcttgtaatattgggctttacaacagggaaacaatcggaagacaaaacaactagatgaaatacattgctaaactgcactttgaaaagagaaaagcaatgaggattcagaaaagaaaagactttacagaatttacaggttgagcaggacttcgaaagatggtaaaatctgttttaagtgtagcaggacagcagtacgtacttatagttggaaccgctccaggaagtagtggaagcaacaagggaaaacagtggtagcattgtaaggaggccacccgatctggagagatcctcttgggaaaccatggaagttaacattgacggtaaagtggaatccacttaggcggaactgtgaacgttgtgccaagaggtctaagactgtctctgtgggtagtgtctggccagtctaggtcctagagcagaactgagacgcgatgaacaatgaatggactatattacgatgagcttggaattgatgagtcaagatccactacgaaataagaaggcgtcacatcgtgaatagagtagaaggaacaagtggtagcagtgttgacagggctctgtaatgtgagagaagaagagtgaaaagccaaaatgactccaggcttttgggtgcagaacctggagaaatgttcctgtaatagagagaggaaaaaaggaaaagccatagaaagatagttaaaatagactgtcatctgcacaattacataaagtcatattgcaggagagttgagactgaagtttgtgaaatagtagatagtatataaaagtgttatcaaaactcaaaaatacatgtggatttaaaggaaaacataatggttttagagaataaggtggacagtgaacaatagcagatcaagttcaggatcaaaagatggaaggatggaaaagttatttttccatctttcataagtcatttcttagaacaggtcattcagtgaccactcggtatctaataaaaatactacatcatactagcctagttaactttcatatacctgtactccaataccagctaaggtgcactaatttgctgctagagtaagaccctagcgattgaatagcagagtctgagaatattttatcccatgcattttagttacttcctgcaaatctcaaaacaatcacaacataaaatagatttcctgtactcttgactttgtatttatcttcaccacagccgtaatgagggttttgcagctgatatactttccatgggaacctcctgagaacacgagcatcagaggcaggatggtgcaaggaagtaggctgtaggattatgatagtaaaccgtattcccctccacctttgagtctcaatcctgagtaagattttaaatcaagttggttgagttttgtagacagcttgttaaagacacagcagatgtcctgaccagtgggcccttttatcctgtaaagacaggctaagaatccagtagtttttattgtcgacctttgcatcttcagggttcccatgttagttccttactaacttagtttctaactaacttccttagttgctaataccattagcagattgagggctgttaccattttgtctccaaacagcaaaaggtgagtgtggaggatcagaagggagcataggctatatagtgtagccttaaaatgttgtcatagtttcacctgtctgctcccaaattgatctctaaaagggataaaaaccgatgtaaagggatctatttggaggtgaaggtttgttctttaaaggataagaatattgcccacgtatatacccacgagtcctggtttcttcccccagattgcaagtagcttgtacggcatgtgcagcccatctgtagttgacagctgtcaggcaagattctcttcagaagcatcagagaggagagagtgtctgttgaccctttccatgagatgcatttcttctcctatttcgatcatatgttttccctcacaaaaatcctcttactccaaccaatgctggttctgcgattcaaacatcgttccctcatgaaacactttgtgttcgctccaaaatcctttgccctcccccacattaaatgtcattactatccagaagcattttgaaaacagccatttgtaacagtgacctttccaatgataattgctaaggattttggatgtgaatgttgttgttactgttcttcagaaaaaccagtatatgaaaatctaaatggcagagaagttgatggaggcagagatagatatttggactttactcaacacttattatgtttaatcttttcaactaccctctgagattagtagtattatctgtgttttacagaggaaagaaaactaaggcttagaaagaatctaaataccctgctaaggtcacacagatactgagtgacaaagccagcagttaaagccacagcctaattctaaaacccgctgagtaaacttcctgttcttgggtggaatctattggcatccagacagtagtagactgtaggtcctcagattacgtgctttgcaatgagaaggaaagagctttttcaacttaaatgtcctcactgtctccaagagcttctgcgcagttgaattcatttcctactttttagtttaagatgtaatcctgctatattaaaagtttctggccaggtgtagtggctcatgcctgtaatcccagcactttgggaggctgaggcaggccgatcacctgaggtcaggagctcgagaccagcttggtcaacatggtgaaattccatctctattaaaaaacaaaaaattagctgggcgtggtggcaggtgcctgtagtttcagctactcgggaggctgaggcaggggaattgctcgaacccgggaggcggttgcagggagccaagatcacgccactgcactccagcccacgtgacagagtgaaactctgtctcaaaaaaagaaagaaggaaagaaagaaaagtttcataggcacagtggtaagggcatttgatgagaagataagagatctggtttcttattctggttctatcattaatttgttgttttaccttaggcagttcacctggtgtcactgggtttgagtttcttcaaattctgccttcttattaaataattttaatgtgcattgttttatctttgattaagactacaaagctaattttgcaaagttttttcttgaggatttctctcaagggaggaaagtcatgttgggtcaggataggtctaacaaagtgaagatgcaaagcataaaaatccaggaaaccacctgaagtggtaagaaaagttagatttaagatttattttttgcatccatcaaacataacccaagtttccgttgggtcttgtgtgtctgttgtaagtatcatgtctatgacaaatagaacttaaactaatacagcataccctatcgcctacagagctattcttttattttgttttgactggtagtggtattcaggaagaaattttttgatgaataccttaccatacctagcaagcaggtcctatatttaatagattaatacaaaaataactgacattacctgaatattttaatcaacctttttaaaagataagtcggttttaacaaaaaagagacaataacatttcccctttctctttcacatacttttcaaagagaacaacgtggtgtggtacttactgttttgcttaaccatggtcctgatttctaaacatgagtcattcctaccccaggttttcccaagtattgttatctgtgtctttcttgagatactacaggctcttaaaacgcaatctggagcagttcattatttcactgtgagaatattcatgcgattatctgcatgtttctagaagtgatctctgcaaaacaattctgctttctgttgctaaaggacctgccaaatagttgaatatcttaatcataagtctgctctggaccttgagagacattagttttattttctgtaaggaagcctcgagagacaaactcaactaggtatcatggtttttctgaatttgcctgtgtttgtgtttaattaaatttttttttcctgcttttgtcctaagttcttaatatgaagttgagacgttttggtcttcagtttcatggcatacttcttttcacatttgagaagcaagactgttatcctttctttctcaaaactaattagaccaatattcattccttgagaaattgttcctaccttttagccctagtcattttcattattcactgagctttttcccagtttatcatgactccttcgtttctgagggcctcaaaaattctcctccccatcacacacacacacacacacacacacacacacagactttcttatgttttaatgcactgttgatgttggtacccagcatctttttgcctttttaatgataataacaccctatttctgttcaaagttatttttgttgtctaaaatgtgtatcaacgctatgttaaaaaccgtggtgtctgccctcaaatatgtcttcaatgggtaaatctgttctgtgacccttttcttcaatctgacctaagcctcaccatgatgtttctgaaaccactgaaaatatccacaacgtgttacctttctcttctcctacttcttggtaaatttctgtgtaatttccagctttggatttctctagagttttccataaaattcttatttcctggatcaccatggatgactagattaggattttctgatcattctcttcccacatcctctagtcttaccaatcgaatgcaatcgcacggtcttgtctcgtttcctatcctgcttctaattatcagaccctctccctcccgtcccctctcatttcatcattttaaatttcctcataactgaggcattcaaatacatgtttctttcaacttgcagttcttaatagaccaggatgagcaataaatatctatttgaagtcctgacttagtagcttttcaaatgttatttcccacaccctaaaagtcgatgcaactttaaagagatctaggtttgaaagagaatacaatatgtgagttaatgaaaggctgttccacgaacctgatatttcagtttatatctgttttaaaaatataccttagaatatcttattgtagtttgcagcttaaggtgttatatagataaattatgcaaactctcattaacaaaaataacttgctatacattgcaaatatacttccagttagaagacagctgttggggaatagaatggtagctctcttttagtagcctactttttttcctagcaggcacaaatcattaggaataaattgtcttctgtcattgtagccagtaattggtgacattttcttgtcactatgggattataaataacagcaatatatgtactgtcaacagattcattatgttatgaaaaacataaaccagtagtctgtgtcttttagctatagtttgcatgttttccgtattaagtatgacactgacatctttacaaattaaaaaaatactcgacagtgcagttttgttactaataacttcaaattttttaagctttaaatatatcataattccttctatttcttccatagttcttctggaaaatatattcttccaagatttctttgtttgcaaacaagattgtaagcatttgtgatgcatcttagcggagctcaagttataagagtaatgataaataccttgtcctcaaaattttagtttacatagtaaatagtggtcacctgtcccatgctgaacaaaaaaaaaataatccatccagaaggaaaattaacatggactaaatgttataattacttgcttcattgataattttgacagattaataattttcttttttgagtctcgctctgtcactcaagctggagtccagtgggatgatcttggctcactgcagcctctgcctcccaggctcaactgatcctcccacctcagcctcctgagtagctgggactataggcacgtgccaccacacctggttattttatttatttatttatttttttgggtagagatgaggtttcaccaggttgctcaggctggtctcaaactcccgaactcaagcaaattgcctgcctcggcctcccaaagtgctgagattacaggcgtgagccaccacaccaggcctattgataattattaagttagatattattttctaatttgagtgtcctggcaatggtatatacctgtcacctctttgacctcccgataaagaagggcaacatctcactttcagtagctgccattgctttgcagagaagaagttttatttttctttgcctttgcaaaattaagacagaaaagactctgctggttatggagagtgcatggaaagcaagctggctgcagcgttcatgtgacccctatcttcctagacaagtttgtcagcctctgagtgagtctgttttgccttgctatcaaggaagtacctgaggctgggtaatttataacgaaagaggtttatttggctcacagttctgcagactacacaagaagcatggcgccaacatctacttctggtgagggcttcaggaagcttttactcgtggaggacggaaggggagttgaagtgtcacatggcaagagcaggagcaagagaaaggaggaggtactgggctctttttgacaaccagctcctgcatgaactaatagggtgagaactcactcatcaccaaggtgatgtcaccaagccattcatgagggacccccctcataatccagacacctcccacacggctccacctccaacattgggtgtcatatttcaacatgagatttaaaggggacaaatatccgaactatatcagcctctgaaccaagacttgaagggcataatttcttgcctgttccctagagtcatttttgggagccccctactaaggggaattgtgactttcctatcgaggagatgccttctaaacttctctgtttctctcttaacagctatacaacatttaaagacttcaaaattttggattcccctactttgtgaaaatactgttatccaagttttctttacctcgtttcttatttattcactcaacaaacacagccaaggcattgtttctgactcttcagggactacaaagctgaaaaacaagacctaccagtgtgtatagtatatatatatatatgtatatttagaagtaactctaacgggagctacagtcacgtgtgagtttcacacgtctttactcacatgctttgtgtcttactatttctgtattaatttttcattattctgggcagtccatcattcagatatccctttcttcatctaaaagttagtcctctaataaagcattttgctactgaaagaggcaccacagtctttttggttttatagactaaatctgagctgtatttgaatttcaatcctgctgtttttttcttggccacttcgttgatatcccttctatttaaaataatgctatctaaagcagcaatataaattgtacactaaacatattctctctctttcataatggaaaattgtaaaataagtttttaaaatataaaccactataacatttttgagacattatgaaatcacatgatgagttgtgttatatatttttcatcatggcactcaaaacagtttgccaaagtggagctcaagtttctattttttcttcccacttaccatttccaaatcacttccaaaatttcaagttcattagccttgtctttcttccctacatgatatctttccattgccatgtacttccatccaattcaaacgatttatttcaaaactttttttagtcctgagtatataggaggtgtatatattacttcttcaaatttcttcctgtcttttgtccttttcttacatctagaaaatttttcccccaattctcttgatcttggcttcataaaacgtctttgcaccagtgaagacaggacagaagttgcatcaaccttctcaggaaaacttaaattctctaagcttatcttccccgttatctaaacaccaaataatcttatttttccattctttccttgcaattcctgtgaagacattgtaatggagtcttctttattatttgccatattgtgaataaaccatgagttttcttgcctctctgcctttgatcataccaccaacaatctgcaataccctcttagccactctttgcagatcaaaatccttccaatctttcaaggctcaacttaagtatctcttccttttagtcatcctaataacaaagggcagtgagctgtccagcctctaaatttcccagatgtttactctctctaatgcttcatgacatttagcatttactaccttattttgaagttatctgtttacctgtcttattttcctatactagatcataagtatcaagaaaaggggaattaggcttctaagtccattccttggattgtgtagcaataaagccacaccccaaatagatgcctggttaaatgttttcaacagcggaatgaacgaaatgtccatggaactaggcacaatgtcacaaaatgctgggaggaattcagagagaaacttagtcttaggcagagaaaggtttttattttcctagtggaaaaacaggtatttgtattctctgaccttttgtaaaaatattttttaaggagttgcgtgttgtggatggtttttatttttatttttttatttttgagacagagtcttactctgttgctcaggctggagtgcagtggcgcagtctcggctcactgcagcctacacctcccaggttctagcagttctcctgcctccgcctcctgggcagctgggattacaggcacaggccaccacacctggctaatttttttgtatttttggtagagatgagatttcaccatgttggccaggctggtctcaaactcctgacctcaggtgatccacctgcctcagcctcccaaagtgctggggttacaagtgtgagccaccgcgcccggctgggaaccgcatgttgtgggtgctttttaaaacaacatttgtaaaagggataatgaatgcactgacttccatgacatagtgttttaattagaattcagaccatttgtgcaccccttatgatagtttcttcttatttgcattcactagatttcctttcctaaatgatttatacacttgcataactggaaattttaaacattaaatttattgcatcttgtcattatgtattaaaattattttcctaatcttgagtactcgaattcgtcatatgttcttatacacataatttatgttaagaattgcttcagcaacatttgcgctgtcatttggcacgcttttggaatcaatattgtagaatactgtaaggggaaaaaataattctaacagttctcccctgtgttcccattaatttgtttattatccaggtcttcattagtaatatagttgctaatgtaagcccataataaacagagtataattgaattttcaatattttgtcacctgggagtaattttcttccaagacctctgctccatcttgtgactaattgtcgacagttactcagtgccaccacattaatgtcatctagcattgcaaaaatatctacctgactgcattatatttaaagatattcattccaagcccttgatattttctttttaaattatttacctcaagtttaaatatcatttaaaatgcaataaatgtaatgagccaacatgttgtgaaaatacagatttagacatcagctaagatttgtttgggtagaagataaagacagtcatgttgggtgtcaccaagcattggagcagcaacgtggcagaggagggaggtggctgaaccggagtcagtgtacagaaaccagagcgatggccattggacccattttttttttttccctgaattggggttgtttctggtcaaattactttttttttcctgtgagttttacctgggttgaatcagatgttatcttgatattacattatgctgaataatgttctaaaagtgtattatcaaaaataagtgaagacaataacaattgaaaatgctagacacaggcagattgattgaaaaatacaaaaatctttgtttttgttggcactgtgtagtcagaatcaagcttttcacaaattcagaacacaaaatagcaaccccggaatactccaggtttatgtctgttgtcccagtgtaatccgtccgcactgtctccttccactcttaaacatgtcttggtttggtcattaagttaaatggtcagctaaccgacaacacatttttagtttagtacctcctctatttcccagacagcttgctaatgacccatatagtaaaattaaaacaactgtgttctgattcaggaatcctacacttgacctaatttgcaaaacttttcaaactctctttgttcaacaatcaaattttgattctgcgtataggcacataaagccacattttgtatttatttattcatttatttatttattttgagacagagtcttgctctgtcacccaggctggaatgcagtagctcaatctcggctcactgcaacctccacctcctgggttcaagcgattctcgtgcctcagccttgcgaatagctggtattataggcatccaccactaggccaggctaatttttgtatttttagtagagatgaggtttcaccatgttgcccagactggtcttgaactcctgacctcaggtgatccacccgccttggcctcccaaagtgctgggattataggcatgagccaccacgcccggctccacaattattccttaatccagatattgtcattgcttgtttctgatacactatatataaagtcatatatgtaaaacaaatcatgtatatagatcatgatattgtttatatgatttttaaattttcattaggaatacagtttcccaaagagaattattcacattatgggaaagcaagagagcctggtgatgctagcacgttatcctagactctgtgggtactctcttagtatatcacaacagcaaagtttgagtgaatgtcttattgtgtgatcatagagaagcaaatctctgtaggtgagtgaaatagagcaaatgtggtagaatgaaaaactgcgatttcggatggcatgctcacttcagttcaagcagacattgatggatgtccacgatgctcactgtgctaggtcatgtggaggatacggagggaaggcagttcgcttgcaaggactgcagtttggaagtggaagtgggattgggagtagctgctccctttcactgagcactcccagtctgtgcagattttgttctcggcttcttaaaggcagtgagctcgggtaagtgtgattcctattttataaataaggaaaccaacatacagagagatttatccctttgtctttcttgagcatctgcatgtgctgttgtgcagacgactggggatatggtgatgaaccaaacagacaggttccctgtccttatgggagcttacaagtctagagggaaagacagacctcgcacaagtgaaccacaaaaatatgtacgcacactgcatacaaagaatggagctggcttctgtgagagggggtattcagaatgtaggagagggagacttctttggaccaggtggccagggaagtcatctctgaaaaagtgacaggtttaaagctgagacttgaggggacagaacgaacaagttagataacatagcaggagagattccagatggaaggaaagcatcgcaaagaccccaggagtgcaagagctaatgggagcgctggagaaactgaaaacaggcctcggaagggtcacccagcggtcacggaggacagtggcataactcatgaaataaggttgcagaggaaagtcgggttttgcagagtttggatttgaaaagattttgaatttttaaaagattattttggattgcagaagtgttttttctcccaaaattgcaataggaagccatgaaagggttttgaacagggagagacatgatccaacttgcctaagaacctggagctaaaaattcagagagctagaactgaactcaggccagtctaacttcagagctcagctccacattctaaaaccgtttcccttgagactctacaaataactgggtacgtggcagaaggtgcgtaccgtggccagtatgcacaggcattgggtagttctaagcgggaagatcgagcatcggatttggactttcataaaaactcgaggagatggcaccagtctggagactagaagcgtgttgcaagggccaggcttggtggctcacgcctgtaatcccagcactttgggaggccggggcgggcggatcagcctgtccaacatggtgaaaccccgtctgtcctaaaagaaatacaaaaattagccgggcgtggtagtgggctcctgtaatcccagctactcgggaggctgaggcaggagaatcacttgaacccggggagtggaggttgcagtgagccgagattctgccactgcactccagcctgggcaatagagcgagactccgtctaagaaagaaaaaagggtattgcaagaaacaggaagagcataaaaatggggcagggaaaagggactgttttgaggggaaagtgagcagtccaagtccccacagtgtatcccacccatagtgtgttactagaaaattgtaaaggtaggttaaagactgaacggggcttttcatgctcgtctgagacattgtatataatgcagtaactagtgaagagtcactgaagatgtctgaggaggagaatgacttgaacagagatacacttttaaaactctttttaatctgagggtgtggatgtaccattaaggaagggaggctgcatgaaggagagatctgtaagacatttgtacagcctgcgagtatgatggcagagtccagccctgagccaggccgtctggccccatgttccaggtccaccgctcactagctctggggccttagacagttttctgcatctcttggtatttccatttcctcgtcaatcaagggggttaaatgagagaatctacttcacagggttattgagcagagataactttattgatcaagtatttaccagacctcttggtgtacattagtacacaaggcaggctagctatttcaacaacaacaacaacaacaaaagactagtgcaggatgggcgcagtggctcacccctgtaatcccagcactttgggaggccaaggcgggcggatcacctgaggtcaggagttcgagaccagcctggacaacatgacgaaaccctgtctctactaaaaatacaaaaaaattaggcgggcctggtggcaggtgcctgtaatcccggctactctcgaggctgaggcatgagaatcacttgaacccgggaggcagaggttgcagtgagccgagattgtgccactgcactccagcctgggcaacgagagtgaaactccatctcaaaaaacaaaaagcaaaaacaaaaacaaaaaagaactagtgcagccattcccctaagagctagttaagcttcagctagagtaaagtgagataaatggaggagttgtgtgaaagactgacatgagaccagaaactccatgtggacaggcaccatgtccacttcgcctcctgtttaacttccagcagctagtgcagtgcctggcattgcgtaagcatgcaataaatatttgtgcatttggattgaattaatatatgaagtataatgcacttatatgtgccctgctatatataaattatgctggcttatagcatacacatgtgctactgatgatattgatcagttttggtaataccctgccaagcaccttgaactacacataaaaaccaacaatagaggggaaaggattcaaaattgttatttaaaatgcctcccaactgtgagaatgtatgctgctcacaaaacttaccagtttcccggaatttaacgaaggccacatcttgctttcccatttcagcaagggtgtgattagtttaccagtgacgcaaccaaggttaacccaggctttggctaaggtcccagaagaatttagtaaaatcttcttgaaagtctctaccacataccctctttgccttcctgacctcatatgaaacctcctcttgtttggcaccagcgcatggagaaagctgatgcaagggtggtctggcttatgggatggtcacccgctcttatttcctctgtgctagcacagggctgacgctgacgggcagtcttctagtgcttgagtctctccgtacccctgagggaggggtgtgctctgaccaggaacgagatcagacagctgtgagagtcccgaccagggctgagctgaggagtgagagcaggtgcttttgatagccaggaaagaattggtctggggatcccccgacagggggaagtcacagaaattagagacggaaaacacctattagtcaattcccatgccaaagataaattgatccctagtgtgtctccctagctccctgaccactccagttagttatatctctgtcaacatgtaaggaggagggaccatgggatgcagggaaaaaaagactcaggatgttaagatggtttcgatactgggatgaagagaagatcagtaatcattaaagaaaaaataatgattttggagaaaaataagagcagtagacattttccccctagggcctgagatttgaatagaggtaggcaactccacaatgggttctatagctgttcttttcttttcctcccctcccctcccctcttctcccctcccctcccctccggagttttgctcttgttgcccaggctggagtgcaatggtgtgatctcgatctcggctcactgcaacatccgcctccagcgttcaagtgattctcctgcctcagcctcccaagtagctgggattacgggcctgcaccaccacgcccggctaattgtgtatttttagtagaaacagtgtttctacatgttggtcaggctggtctcgaactcccgacctcaggtgatctgcccgcatcggcctcccaaagtgctgggattacaggcgtgagccaccacaccgggcctatagctgttgttttcttaatgaagagctgatgttatttatccaaagggaagaaatcgtcttgttcatgtggtcctcattttgtgctagggagtagaggtcttgagtgagtattgctgacattgctagaattagaatatgcattttgcttttggagtagtgacagtagagaaacctaggacgatgctctgatagaatgtattaaagagggaattatatggtagtttgtaaatatgtggatttggttgactatctatggctatgaagagagccaaaggatgttatcgctaaagataagatcatattgagatgcaagtagatatataatgaaatctgaattggctctgttttgcttggactattttcttcattatttataagaagaaaaaaggggctaattctcaaactatgtgtcagtaatttctcttgattttaatcacattaaactagatggctgattcattgcatcaactttgattgatatttttgcaccatttcttgttttttttttttatattttcaagttatacccaggcattttgttgcatatctcacatccaaaatagctcaaatgagcaatatcattcccagccaacctctccccgcctctctcattcacactgcagttgaaggacttttccaggaaatgtttagagaaccatgggctaaatagcctttgccccaggacttttttcttccttcattgtatttgttttttaaacttatcatggtagagctaactcctgctgctgtcttctctctaggcatcaggtccggggtgcccaggctgcctcccagattccacaccacagtgtccatgatagcagcttgatccttcagccagatccactctgcacattgaaaggcaggcagaggtcgaagccataggccccaaattcctgtgatctttaaaaacctcttttcaggaactcattatgtttatcacacatataaaatggtggcaggtgagctcatccttttcagggtacctgatgccagactctggtggttcctcgacccatgatgttcaggctgatcacccttgctacggttcttacagttttagttccatatgaggaatccatgagctgggaccacctactcgttggtgttgctaaggaaaaattcattctggcgcttgctaaaacgttaaggaagactattcagaattgttgcaactggtgtcaattctgttgcaataggggagagacatcaggctcaacctcaattatggaacgagtggggatttacagccaaagaacaggtgtggagtcggggtggtggatggaaaattactaagaaaagacatcagggtagggagattcttgctaaactcacttaacaggattcttgctgatggtaggccaaggacttatacatcaagttgggagatgaggaatttgaccagatatggaagatgtgggggttctctctaaactgatttagcgagagtcttgctaaatctgggctatgtgggcccagcaaggggaagggtgaagaaggtggaggcctagtcaaacagagcacttggaggggcctgactcaagtggagtcaaggagagagtctttgtcagtgtgacaagcagcagttgttttaaaaaacatatttttatttatttttttaaattggagactcaggggtacaggtgcaggtttgttacatgggtacattgcatggtattaaggtttgggcttctattgatcctgtcacccaaatagtgaatataatacccaatagatagtttttccatgcctgtcttccatccctccctccccccattttggaatcctcggtgtcttattgtttccatctttatgtctgtgtgtacccaatgcttagctccctaagcagaaagaacaaagccagatgcatcacattacccaatttcagactatgcttcaaggctacagtaaccaaagcagcatggtactgttacaaaaacagacacatagaccaatggaacagaggaggaaacccagaaataaggctgcacacttacaaccaactcaccttcaacaagcagcggttctaccctaagaatggatacatcaaattcagctaagtatggctctgccagaggcaggaccgtatttctgtgcatgcacagtgtatattcttgagctcatgccaggctctccccgcttcggtcagttttgttttgggcacttccctctcccatgctcattgggcctaggaagtcaggccttcaggtttcaagaatacggatagtgtgtagggaagggacgtgagaaaagcccttggacgtgactcaataatgatgctcagatctttcacactcaccctgtgaagccgactttttcaaatgaaaaaacatatactactcacatgtgacattttattcagagccaaaattataaagcaaaggagttcatgtgtttatacccagaaaaattggcaaagctttctttgaaaatgtctgctgtggttcagtttttttttttttcttgaaaatataaatggttcttcatttagtaccattactttgaaagaaaattacagagtagacgcaggtaggtgtcactgaggagttttattatgtatgtttacaaacaaagagtataaacaaagaaatgcatttgttatacttagtgcccccaaaatcatttgtactaaagtagcccttgaacaagctggaaaataagtggaataaatgtggtactttggttcctttccattgactttcaaaaacaccaccgatattgaaatatttgtgtttcctttgctgtagtgccagcaacataatagatgagaagagagtagctattcactgttctccagaaatacaacttagcctcttcctgcaacttgagcctccacactgcagccttcccttgtctctgcgatttcctgcttgctccctcctctaattactcttctttttttcagactcctttcatgagtctcctctttttttgtccccctttattccctcttgcccacattccacatttcttttcaacctccctccgtatttggctacagtgtttaaaacgagtattaagtctggaagctgaataagccccatctcctaaaaaacagttttacagattttctactgacagagttagcagtctggcctcagtgctggggaactgaaaagacccatcagcagcctgaaaaagaagagcttcttcatcagtgcagtaaactgctctgcggcttcagcctcatttttacgtagatgacggtgtcccccagcattgttgtaagtacaaacacatcatcaggcatcctggaaagaaaaatccttctgcttgtccagattaaactccgaattcatccaaacattaaatgacaagaatgttgagttgagaatgtagaattgtaccagcagggaatcttaagaggtaaatctgggaaaaggaagttttattgtgcgtcttttttttttttttttttttgagacggcgtctcgctctgtcactcacactggagtgcagaggcacgatctccactcactgcaacctctgcctcccagattcaagcgattctcctgtctcagcctcctgtgtagctgggattataggcacccacaaccaagcccggataatttttgtatttttagtagagacaggatttcgccaagctggccaggctggtctcgaacctctaacctcaggtgatccacctgcctcggcctcccaaagtgctgggattataggcgtgagccaccgcgcccagccagtgcatcttctaaagataagaaattactattactctattcagcaataatccattgcaatatttgatagaggctttgttaaaagttattttttaaatgaatgaaagtaaactaaatgggaaatgaaacaaaaaaatttcatattttaatgaatttgtccttttctttgcctctaagataaattatttcaacaagaagctgatataaattgagaatttcttaaaactactggtagatgacagatgtgttttaaattatcatatgagatacagctatttttcttggaagaatacattgctatttttcatattattattatttttaatggcattcttataaggtaactaaactgatatccaaactacattttaaaaattgtgtcatttctgattttatacctaggaaaagtaatatctaccttttaaaaatgaaaaccctcccaagaatattataaattagcattgcttttttatgtgataagcagcaaaatctcactgtttgacttagaacgtaagaaagaggaagtgaagactgatcacaagtttctatttggagaaaatcaatcatgcactcaattagaattcgcaaaagtatctttgtgccttttgtttaaaaatttcagtaaacatagcccagtctgatttggaaccctcataattgtgaatagcaaacaacttatcacaagaatagattcccacaaaagggattctcacaaaatgtctgggtattgttaacacagaagggacaagaagttttaccttatagcactgctgaagtgtttgtgttttgaaaagaaagaatgatatataaaatagtgagaggtgacagcgtgctggcagtcctcagaaccctcgcttgctctcggcgcctcctctgcctgggttcccactttggcggcacttgaggagcccttcggcctgccactgcactgtgggagcccctttctgggttgaccaaggctggagcccgctccctcagcttgcagggaggtgtggagggagaggcgcgagcaggaactggggctgcgcgcagcgcttgcgggccagctgtagttccgggtgggcgtgggcttggcgggccccgcactcggagctgccggccggccggggcagtgaggggcttagcacccaggccagcggctgcagagggtgtactgggtcccccagcagtgccagcccaccggcgctgctctcgatttctcgccgggccttagctgccttcccgcggggcaggcctccggactgaagcccgccatgcctgagccttcccccgcctccgtgggttcctgtgcagcccgagcctccccgacgaatgccgccccctgttccacggcgcccagtcccatcgaccgcccaagggctgaggagtgcgagcacatggcgcggggctggcaggcagctccacctgcagcccctgtgcgggatccactgggtgaagccagctggcctcctgagtctggtagggacgtggagagtctttatatctagctcagggattgtaaacacaccaatcagcaccctgtgtttagctcaaggtttgtgaatgcaccaaccgacaccctgtatctagctgctctggtggggacgtggagaacctttatgtctacctcagggattgtaaatacaccaatcggcaatctgtatctagctcaaggtttgtaaacacaccagtcagcaccctgtgtttagctcaagctttgtgagtgcaccaatcgacactctgtatctagctgctctggtggggccttggagaacctgtgtgtccttggagaacctgtgtgtccaaactctgtatctaactaatcggatggggaggtggagaacttttgtatctagctcagggattgtaaacgcaccaatcagcgccctgacaaaataggccactcggctctaccaatcagcaggatgtgggtggggccacataagagaataaaagaaggctgccggagccagcagtggcaacacgcttgggtccccttccacactaaattttgctactgctcattgtttgggtccacgctgcttttatgagctgtaacactcgccacgaagatctgcagtttcactcctgagcccagggagtccacgagcccaccgggaggaaagaacaactccagacgcgctgccttaagagctgtaacactcaccgcgaaggtctgcagcttcactcctgagccagcgagaccacgaacccaccagaaggaaaaaactccgaacacatccgaacatcagaagggacagactccagacgcgccaccttaagagctgtaacactcactgtgagggtccgcagcttcattcttgaagtcagtgagaccaagaacccaccaattccggacacaataggactctggtttctaaggggtgataattgcaaaaaaaaaaaaaaaaaccaacaaacgaaaccagccattcagtcttgctttggaatttttttttctctccatggttaagcaaacgtgtaagcatgtatctgcatgccccaatggagactcgcactttcgcaaattatgaggaattaaaccttgcgaattagggtattttcaaccatctgggcatctggggttgctctttcttttctctgtagctgcctcttccccttcattcccagctgcttccactctagttcaaagttccatcgccacttctctggaaaccaggaactacttcccacctggtctccttgacgtagcagtccctctcagtcctctgcctggcctcatcaagacttcttcagcctgcttctattatgttgtttttctaaaaaacagtccgatgatgatgataacaaaaataataatataataaacatttaatgtacacccacttcttcaacagtttctacgcactaagctgtgttacatcttttgaatccttattttgtttaattctccaaaacagtcttgtgaattgtgcttgagtactaaccacatttaataggtatggatttgaggtttaaacgggttaaaagtactttgcaggaggctatgcagcaacttttccttgttctctcaccaagtcaaaaatgctctgctggcttttcaaacatctacatccatcctactaccttagaaacactgttttcaatgtaattctttttctagaacatttggtagaagattaactggaaatttgctattgcttttgtgtattatcatgcttttgaatctcaaatttagatcataaaggaaattgaatgtgaaactctctggccaccccaatttttcagaagcctttatctgtgtcacaaacaccagaatcattttgaaaatgttcgcaatctatgaccaaaagttgttggctctgcaacaagagcagactgatagccagcaccaagacagatggaggtgatgttctaggcagaggtggcttctagaccttcctttgcactgccagcttctagtcagtgttattaaatctagtccctttcataactgaaatttcaaacataaattatattgcaacatccctatagaaatgtctgaagttatatatgaagaaggaaggaagatgctgttctcaatacatcccacatcattaatatgtcaaatctcttttcttgtttaaaatgaaactgggatgttttccaacttttcatcctgatggtaaggatagttgcccgtgttgggtagggaagggagggaggtgtagctgaaagtacagttttgtgtttccactaatctgatccctcccaccagctgccctttccacctgccctacaaactctctgctcagaaagtacacattgatacaacttatcaaagccagccctctgttgtagccatttcagcaaaataagccaatttgggtttggtagatggaaaaaaaaaaaaaaaagaactatgcccaggccatagagattagactttaaaacagagctaaagtaattccgaaaccattttacctgccagaaaaaaaaattacatataattactttaaaaattagccattttaggtcagcgtatgtggcacaaagaaatctgaaatttaactatctaacagggaatatgacaaagtggaaatttgtttaactatgcaccatatcgtagagaaggcaccaatacgaattaggttatttctgtgtaggcacaagactgtagttgcaaagctgcactgcagtagatgactcttttttttttttgagacggagtctcgctctgtcgcccaggctggagtgcagtggcgcgatctcggctcactgcaagctccgcctcccgggttcgcgccattctcctgcctcagcctcccgagtagctgggactacaggcgcccgccaccactcccggctaattttttgtatttttagtagagacagggtttcaccatgttggccaggatggtctccgtctcctgacctcgtgatccgcccgcctcagcctctcaaagtgctgggattacaggcgtgagccaccgcgcccggcccagtagatgactctttaaaggtcattttagcaagtgtaagatagatcttttgagggtgcacatagcccacctccctcagtttggttttctgtttcattgactgtattagcgttaaactttttaagagtgacaggctgcaggaaggggatcccgggtgggtcatgggatctgcacagccagctgttccttagttcagagagttcttctttttgagatttacagatccgtttgcatttgacagaccatggcaagtctttgtactgcccagtcccagtgttttaaaggagagcagcttaataatttattaactgcaacatttcctctgggctttatctgtgtgatgctgttgagtcacagaacattataaatatgaagaatttagcagaatcacattctttaaaagagctatggcctttttgttgtggtggttgttgttgccaaggactcctctgagagctcttgttggtttacctggttggaaagcagcagaaaatggtcagctttgtaaagtgggattgcagtaccagtttcgagtttgctaacaaggtgccctgatctacaagatcgttagccatggaatgacagtaaaatgtggttgcagaaggttttgagacattcctgaattgtctgtgtgctgtgctgatgtggcactactgacactctcctaccgcagtgccttggtttctgcggttccttcagcccgaggcacactgccgtccccatctctccacccttcagcaccttgtcagtttatagatcatctcaaaagtgactttttttccacaaggctcttattgatcctcttcaaaatggatattgcttctgccttctcagactcatttatgatacttacatgtcccacttgatatgatgattactgttaacttttgcccaatctggagcaaaatggcatgatgtccacggcagggttatcctggatgtccctgtgtagcccaacacaatcgtgcacatgggagatgcttgttcatttaatagaatagctgttaattctgcgcaccaatccctcttctcatgtttcttgtccttatcctaattgcatataattatttaatgatgttctcagccatttgtaagctatttttagcatggaaaacaaattacctttacagacttttatattagagtaatattaaaaataatagctgccttcgtaagctgttcttcagtttacagaacattttcatacatattatttgatccgcctgtgtagattatgcccatccgtgcccatgactgagaagagggcaagagtctccctttacagattaggaagctgaggcccagataaattaactaatttatccagagttgcatctctggtaaatttcagaagttaaaatcaaacccagatgtcctcaggattctagtacgacttgttccacttatatataatttttcatcaaagttactgagcgctcattgtgaggcttgaatagacacagttaaataaaaccatgactggccctggctctaaggaggccagcgtcctgcaaacacaggcacacggctgttagaaatgaggacgcagccatgttgcctcactgcctggactaacacacaatgaaaaagcaacattcattttcagtaactgagcagattcaataaatgtaatggcatttaatgattatgcagctcgtagcatcttttattcaaaggtcaattccaatgcactgtatagactatttactctttttagagatggcagagataatagattaggagactacctgcatggaagaaacaattggcactggcctgcataaagttggtacttaaaaatgtttattgactaacgccatagtgatttgctctatgtttctgaacttatccttttatggttgacttcttcctctacaaaatgggcaaaaaaaaaacatgcttatgaagtacaattgagaaaatatggcataatatttcatttaaagcagtttcaggcataggctgaacaaattgctcaaatgttttgttccttaattttacaagggatgctccagagaatggaatctgactagatttttccccatttttagttaactttacttataattcaactaccagtactctcaagtcactgataataccaaattgaatggctattttatctataatgttcttttatctcaaatggggaaaagggcacattttcatataaggctgtgggatgtgaacagtgaagggtcgttcttcctctaagcggctctccattgctgcagccacctgctctaccgtacggagctgaggtaattaataagaggtattaacacgtctggtatcaccggggagagggaaaaccgaaatctgttgaatcgctttaactgtgaaacagcaaatgttgatttactcaccatctttcactttaccacccagcttgccatcatttctgcaagatgtaataaaaagtaagctcacaccccagtgtaactttaatgggtttaattacatgtaacttgaaatatgtgtttggctacatggtacgtccagccaccaatccataaccagcatttttggaaaagcacagccagcactcaggagagagatgggaattagaaatgcagactggggaggagagatgaggccttggagccctgagttattgcccatgtggggagcgctgagagcggaagggagacaggcaaagccgccaaacctaggggaatgcctccacgtggggcgggggtggaaacagagaaggaggcaggtgtgaacagtagagaaatagaggcaggctaaagagagggcatcgccacacaaatcaagagggaaattaatttcttgaggatgtggggcttcaggttgcaacggtgagtgaggaagcactgagaaactaggagaagctgtctgagctattttttaatgaagtttaatggtgaatgagaagagctattgggggtgcaaaattgaagagataagaactgaataacgatagaaatttattttgctaacaattgatgagatttgtgagtatctgtgtaggctgaagttaaagactcaatggagaaagaaagtaaagaaaatgtcggtttgtctttgagggataaaagatgctatcggagcgtttcctcttaatgagatccatttccatcaccgtctgtgtagcacaccattaaaaataactaacagacaacgtctttttaaatgacacattattttacttaaatctttacatctgaatcctgttcctgcttattttcctgcacttgttgacaagtcattaggaaaaacagtgtttagttcaatatggcctgtcatctaagagacctgtgtagcttaaataaaaaactgatggattaatagtagttaaaaaacaaaaggcagaatgcgatggatggtcctgtatcttttcacccgccataatatacgcatctttagacatacatacacagagataaaataagcagcaggagggaaataacatatagaaaactagaaaatcaaaatgagatggctagaaacatttgcaaataatttataatcaaaatatagaaataatcattccacaagcctaatttatttaatatatatgtgctgccaaaacataattcttatcttagaatttcataataaatgcaataattaaatcacacagagtagacattgacaaaacagctaatggacttcggatttagcatttttaagatacaggatttcttttatgtgatcctttgcattgatattatttttaaataccatctaatatcctgttatggatttttttagtagactgcttaacaaaatgtcaccaatccatgagagctggcaggaagtcaatgacactttatcacagaggattgctggcatgttcatcataataatgatacctctaatatgcattaacagtttccgtccatttctcaaaactattgagaaactattggatatcagataccaactgaaatgtggccaacttgatattatgacataccagtcatttagagctcttattccctgaccagaaaccatgcatgaaggcagagaacaattatagtctcagagttacaatcctagggaagaagagtttgtggggagcacgtggtgattcaaaataaaattgagtaacagaatgaaataaacatcaccgttgggctatttcaaaacctacagagtagttattaagaaggtcaccaatgcatctatgatatctacaagggctgtgcttggtctctaactgctcgtggaacaacccactggtttcttttgctgcctaatgtatgcttatatttatttccctagggaagaaatctgagaattttttttttattatggggactttacaagcaaaagaaaagagcatatttacctattccttcctgccccccacctatgaaagcaaaactgatcttacgcaattgaaatacatgcgcatacagaagcaaaagttacgaattagtatgaccatgtatacatcagattgaccccacttatcttgtgaaaaaataagattacatgctgaagtgatgtggtaataagcaattaaccaatgaatcagggtggaacttatcctcttaataactgaaatgtggttttactgcatttgagagcagtataatttcaaagagttctatgtaagctctgaggcacaaagttctaagtttttgttttaatcatttctgtattttattttccatagacactgattattttatgccatcctttccacagttgcttgaaaatgtagtctagagaatcaaattgatttttaattatgagttcttgattttagccttcagataaactaaattgaaccagaatattcttaaagcataaacaatggattgtctaaattcccagctctcatttcaagtattcgctaatgtggcattgatcaatctacaattcccagactgagcagaagtgataggaatattggataaaaaatgccgtacaggccagaaagataaattgtttgggttgtctttttgcaagtttgaggtcacgattcattcatcttgttactttgctatatccctttagtggcttcaattgcaggattaaatattgaatggtggcagatcattcaatatataggctctcatagtttggcattagagggcttttcatgcttagaatggagctgtgtgcacacagaatgccaaagataatcgtgctgatgatctagtctgtgagattaatccctcaacaatattatcagacaattcttaacacatggatttgtccctgatatgacacttctgaaacaaatggatatactaagcattttaggagtaacattgagcctcctatacagcctggctttttcaggaaattaacccattaggagatttggccagaaaagtccaacactttatcacaaccagtgtttatgaccacaaaattatataagagtcaattttaagaatcaaaatgcttttagggagtactgattaatagaggattaaaaaataaaaattagtttgggtaaaatgtggccctcagggctaaatatgccaaaggaaagtactaaattaatatactgtcttataagtctaattagcccaagaatattcaatgctgagatattatgtttaaaatgttttaattgttgctctccttatgcactttgataggggagatgctgagccctttaaaagagaaatggaaatgttaaaggttgaaaattcattatttagtcaagagacccggagtcttgaaggataaatgcatatgctttttaaaaataaaatgttttatttataaaacataaaaattaaagtttgacaaggacaaagaggtcattcagtttctcctcctgtttgtgcggaattattttatttcacctttggctgaatggtctgaaatgccccagatgttaatttttcgctctgctctgaaattgctaaaatccagaagttcttcaaggtaaaatcatcttggggtgtttagaggaagagaagaacttgcctaaaattgttttgtcttagaactacctaattcactgtccccaaattgttatttttaataattataatgattccattttatactataagcagttgtataaaatagaattgtcattccatttcagttgtcatatttcattttttttctcaaccgaagcatatttgaattttcctcactttttacaaaagaatttcagctttgagactcaggggtacctgtgcaggtttgttacctgggtgcattgtgtgatgctgttttcttactttctcataagtcagttattctgttgccttcatcgcctgcattcatctctggcttccttccaggctgcccctgtctttctggatgaggctgtctaaatacagttttactatcatgaggaagcctagtatttctagagacagtataaaaaagaatgcaggccttagagtcagccagtcctgatgtcttccacttacagctgtgagactttcatttacttattgaaatcctctgctccttggtttctttctttataaaatggaatgcagctatctacttcacaggttgttgtgattcttaaataaaacaacagtggctggcacaggtaaacaagcaaaaaatagctattattatcattatggtgcacttcttcattgacatgttataaattatttcagattgaggtggaagtcttttactttgatcatttttaaataaaagagattttgtatttgtctatgacttcttttgaatcaagccaggttgggttggattatataaaagaaacaaatcctgaccaggcacggtggttcacacctgtaaactcagcactttgggaggctgaggcgggtggatcgcctgaggtcaggagttcaagaccagcctggccaacatggtgaaaccccgtctctactaaaaatacaaaaattagccaggtgtggtgacaggcatctgtaatcccagctacttgggaggctgaggcaggagaattgcttgtacgcgagagtgggaggttgcagtgagctgaaatcgcaccactgccctccaacctaggtgacagagcgagactctgtctcaaaataaaaaaataaatatatagaataaaataaaataaatctcccactcaatataccaatgaaaagccgtaagtttaataataaaagaatcttggaatcacatgtataatcaaatacaattgcttccatcatcatgttatgaattaggaacagaagagttaactgtgtaaaaaagggaaaaatctataaggatctggacagggagactctgactcagtaagagaaggaaagtgtgagcagagtagggagacaagtaagaagtagtttttaacataaaaaaaaaaatcaaattagctgggtgtggtggcgggtgcctgtaatcccagctacttgggaggctgaggcaggagaatcacttgaaactgggaggtggagggtgcagtgagccgagatcgcaccactgcactgcagcctggtgacagagcgagactccatctaaaaaaaaaaaaaaaaaaaaaaaaaaaaaaatcaaacaagaggtaatgggagagagcagaaaaaggcaatgaatggagagtctaggaggagacagcataattgagcactcactgtatgccagaggccacaggacacatttgtattaagactgtgatgtgccttttatctccactttatggatgagttatcccaggctgagaaaggttagaatcacacttaccggggctactaccgtaacaagcaatggagctggtattaaaacacaggcattcctcacaatatcatgcgctaaaccagtggttctcaaccttcggtgagcacggaatcacctggagggcggctaaaacaaattgctgggcccccttcccccaagtttctgattcggtggctctgggctatgacttgcgaagttgctgatgttgatgctgctggtctggggaccatactatgaggaccactgctccaaatgactgcgctctacttctgtgccgtggtcaataacgatcaagtggcacccctaggttagacgcagtggtgatttcattaggttcttacatgtggcccctccatgtggcaggctttagttctctgtttcggataagtctggcatttaatattagagaagtactttgagtcctggaggaagcagtagcctggacagcccatcaaaatagaaattcaaataaggggactccagttataaggaccctttgtctcaggagcagggcagaagctcatttactacaaagtgaaacaccagattggatcgctcgcgtggaggggacttgatgctggatcctttacgtgttaaactgaagcacattaagtttcttcttactaagggtgagattggctccagatcctggacaggcattaggctgtgagtcctatgcctctagctatgaggagaaccagaatgtaaggacaaggggacacacacacacatgcaccccacacctccactggggttactgtagttactgaacaattaccacaactttttctctatatattcctttatttcagaggtgctgttatatagattccacacagtgtttgttgactgactgcccagtatatattagctgacttaactgtgaatcgctgtgagaggggcatcaaagaaaagtgaaaagtgtctctatgtctttctaacttagtatgctgggttcctaggaatgagtcgcatgcagataggagttgaataaaatctcatctacatacttgattggcagtgacttgaaacaggggtgttacaggcatggaacgtggaggaaaggcagatgccacattttcagtttttattttgctgatagccaattggccaaccagatatagttgtgacaaaagctaagtgtctctctttagggtaaaaggaagtcattacaatagcaccagaaaacatttggtaaggtctttttgaacttggcagcaccttgggttctacgcgaataagtcagaagacctgaactgtgatttgggagttaaaaaatggataattgccaactccttagttcaattcaattcagtgcagttcagttgagttcactcagtaaaatccagcaagtgtctgttgattgcctacttatgtttacactatgcacagtcccgaactcggtcttgtgatggataagtctgggctctgtcgggcgactgaggtaccctgtacacttcaggaggaacgtttcagctttcagatgcattgactaataagcttataaatcattacatacaatccgtagagctaagtggtacctaaaggaattagcagacctcaaatgcccggttcacaccttggctaaactatgagttataaaggtaaatatttttggtaaaatattttggtataggaatgagtgcagacactgttttagaatacttaagtggtacttttttttttcatctttaaaatatcctagactttgtttcttcatagagagaacctcctaactgaattctaaacgtgttaactgtttcctttcagtgaaagctgctgagcagaagctgctagcagtggctacctttgaattcccattatgctgtgacagccagtagtacactgcttaactgggacaatttgtttatgggtacatatttctgcgtgtgaaaattagctatgagttttcttggcattagtgattagtaatatttcaactacctgatcagaagaaacattctaaattctatttgctcctatagacaaagacaaaacaagttttcctctgcaatctctgtgttatgccatggcccatttgagctgtacaacgcactgcttgttcagtttttgttacaaccttcatggaagatgaaaaacataccccaaactgctatgcaataagatcattgctcgcctgccagtttgcagttttatatacagcatgttattgttgtggaatgaagtttatggagagtgagtctctggtagtctgtcacttcacctgactacagtaaaagggtctccaggtaggctgtttgtaactattgtaaatattcctagctttgcagagtcttggtggtgaaatttatgaattaactggcactccttctttgctattttaaaaattgaagtttagtttcaaaggccattacctgttttacttgtgtgtcttggggaaagaggagacagctcttaagatattgaaaatattttcttttattttctgtctccatttttttgttatacttcagagaccttatgtaatgtttaatgtttccatttactgtatgcattttcagctttagtatttgtcatcttgttccaatttaatgaaagcttatttggctatggttttcattggaaagcagaacacacgtacaattttcagcaataatatatatttttccttttctttggatttgaacagccttctaaaattttctctactgaaattctggcagagttatttcttcaacatttggctgagggtttggaatgttttaaacatttgaagtgcctgggatcaattactgtaacctaaaatggataacctttaagacacaaagctcatgtttttcttaatcatctcattacatgacatttttctgtttgtatatcaataaaacactgtatgttggctaaataggctcatttcatttatttccaagtactgttgatattgtaaagctagcatattacatttaacattaaagttatttttaagatataacatctttgtggatgagaaaaataaaatccagaagatggataaacttgaaacaatttagcagtctaacaaagtataataaatagcaaaatcatggatttgaaatgaatctttaaaaaattcacaatgcaagcatatttttaaagctctgtttttctaattaagggagctccaagagctttcttatttattctcactagtgttatttcgttactgaaaagttttttttccactataaaatcactgcttcctctgagagatgcttacttagaagggattatgtaggaatatcctgttatttctatttatcaggttaaccgtggattcatgttatactatgggggtagaaagcaaggcaaggcattgccagcttcaagatttgacttttgataaatataaatgtggagcaaccccgtgctgctggtgcgtagtggatgtgatccatgacgggcagatggctgtagcgatggagagaaatattatagccagaacattcctgcttctgctccactggactcagaatacattaacagggtcctctctcagcttggagtttttttcccgatgatggattagtgataaactcatatgcaggttattccggagttcctctgaaaccttagcttttcatgaatgaaaaggtcctttatacattttctacatcctttaatttttttcccatggaactagattgctttgtacaaatttatatctctgttatcttctttgaaataatagagagcagttgtccagttttaatgccttaattatttgtttggtggtttggagaaactttactgttccttaatgaaatacattacatttagtaaagagagaacttaaaagttgaaattattctttaaaatacaagctaagattctcatgaagccagaagtctccttgctcatttcgtcctaaatgacttttgatataaggccaaactttgtgccagatgtgtggtattttacaataattacatggcacaaacctccagtcatttccactgagaccattcaacatctgttttatcaaaatggctttcagttttttttcaggtccacagatgagtaagaatattaagtgagacactgagtcacttactttattatttcatagtgtgaatttctcttgtatttatctgttttaaattgccacagacctaaagatttcttttaatgactggtcataacagagtttgtttctctgatattttgaggtaaaaattttaaagacattcatttaacatttacactttctattccctttattctgttacacattgtagttccaaatgctgatgaaaacttaataaggaattggtcaggaagtagatgagaagggatggtgcgatccgttattaccatttccactttgagacccctttagcttttgaccagcctacttcactgtaagtcttcttatctgtgctaaacagaatttacaagtatcgactaacaaagacaaatagtcagaggtcataagtggaagggatggcagacccacgtggcagcgtgaaacggttcttactcacctgtgggtgctcccaaagctgcatgaagggccatttgctaatttccctgggctcaggtgaggggatatctctttctgaattcaatacctgctcacgtcactcactttattggaatacccaaatgcacaggtcgtttattttgctattcttaaatattttattcaaaactatacgcggaaagacctttatgttaattatttctatctagatgggcaaaatattatgtttgggaaagtgtgaattccctcagtgacttttgtacagtcgctccacatgcctcaaaatcttgtatactaactggctgctgttacagtaaaaacaaggtcagtgcagctcttcaaaacactgtgctttcccactgacgtttgtacagtagtcagttttctgggccaacgtagacgtagccagccataaaaataaacatgggcacattcatggcccaaaataaatcaaagtggacataatgaaaattttccagtaagcttaaaagaaaatttaatatacttctcttctttttttaggagggtcaagcagttggttcggttttcattggaatttttatgtgggtaaagcttcctgtttgctgcgcttgcctaggattttcttatcccacaactacaatgtgaacaaagagatgagagagaaattatgctaatgcattttggtggatcaaatgagtgtttcatgagacaactcaaatttttgttagctatatggtgttggaatataatttcaaagacaactaagccctaaaataggagatttatttaaaacataacttttccttgaatgaaaggatgtttttgttctttctctgacaaatatgatttgagaataaaaggaaatatataaccatgatggaaatgtatttttgtcccaaagctgatttgtctcagatatttttggtcacagttcaattatttcaaaattatttttaggtttttagattcttgctttggtcacatagcaattttgttccaaagatacgaaaccatgtaatccgaccatttccgaagctgggctcttcaatatttctatctttcagacacagtttggcaaatacggcagctcagtcaagtgaaatgtgctgtaagtcctagggttgattggtcaagaataagatttctccagtaagacatttttacaaaggcacgatgactatactttcatagttcaaacaaacagagcataaggaattattctgaaatataatgatggtacagctgtaacaataaaaaggtctgtaataaataaaagattgtgcatctgttttagaagacctctgactgctataccttgtaacttgccacaggcctgatgcactatatcttaactctaagtacaaatgcaagaatagtgtatatcctacattatgttatgtctcaaagaattttagacagatagggacacactatctgatggtgaagagacggaatcgaagctgaaacatcagactgaattatgtttaagtattatctattcttctgcaaagaaaattagcttttatctgtttttctagaagtagtgatgtgtctctgctaaaagaagcacattcttaccaccgtggaacaattggatgcctttatgaaaccgatgtagtttaatagcaggttcttttgggtgaaaattgttttctagttattttattttattttggggatggggtcaccaggctgtggtgcagtggcatgatcatggctcactgcagccccaacctcctgggctcagatcctccagcctcagccttctaagtagctgggaccacaggcgtgtgccaccacacccagctaatttttaaaaatttctttgtagagaccaggtctccctatgttgcccaggctgatcttgaattcctcgtctcaagaaatcctcctgccttggcttcccgaagtgctgagattacaggcaagaaccactgcaccaagctgtgaaatttgttttcttaattggtaataagaacttgggcttattatcatcgtgctttagaatttgctaattccttttttcaatcactgtcagtacagtctgactccttttaattcctgacatttttgttccccttctcatccagtaaaataagaataaccacagcctttactttctccagtgcagtagggtgtcaggaggactattaaatataaagttcttaacagtttttcagtgtaacctaaatgtgaaaaatctatgaatggttaacagaaagtattcaatctaaatcctccccaaggtcagaaatattattttggaatatgaaaaactacacctacaaaatgaagtaattcatcactttaaaaaacaaatttggagtttttaatagaagccaaactaactcagacatctaagccatcaataaagcttgccagaatttgaagagaatatcacgatgtaactctttttatggatcaagtacaaatgaagttgacagtgtatgcctaatcagagtgcggagaactggaagccgccgacagtatttccgctttctcatgttgacacattgtgtgtgcaggcagcagagccaggctgattaaaaatgtcaagactttgctaatgtgaagcacatgctttcaaaatctgaatttgagttcacgaggccccaatctgcagcgtgtaaataaagtacatttattcattaatgcattcacttatgttgtgttcaagcaggacaactcttaggaaaccacgtccacgttagcttactattgattagaatatacagctcctcatcaaaggagcttgagaactggaaccacacagctgtgagctgaggacaaggccaaggtggaggtgaacaatcattgcattctccttgaatgctctccatcatcgccggtcacagcgctgactctctcccttggaaggcaattgtcttcataaacagtagagagcatcgggaaggtggctgagaatggctgctgaggaactttattgtattgcgggactccttgcactagcttcttacctggcttttttggttaagtgtatgagaaatcaaacccagtacccagaacctgagaaaggtattaggcgtcattactcactactcccagccaaaaggcttcatggacttccatttccctagaacgtccagctggcctcccatgagggaaaatgagctcccagccgccgtcctggaacattccctcacctccccgctacaatctatcgcttctcctgaatgcctccttttgtactcacagtagatgttgcgtaattttggtgagagaaagaacccaaaccaagggctaacgtgatccttacctctctcgtcacttttcctttgtatactgatgagagcgtacctaaggttgtgcattgagcgggaatagattggatgcatgttgagtgtatggaactatgctagacactaaaggagatgacaaatggatagtacccatcatctgtatccttaggggacttgccatataccaaagaaagaattaacaaagaatttgaagtggcacttatccatccgtttatttaacaaacgttcagtgagtacttgtgctgtgtcaagctaggtcctaggtactggggatatcacagtgagtagaagacttggtccctgctcttcctctgtaattgtggattcccaggagagcagtgcaggcaatttatgttgtaggagcatgagagagttgcgctaggcattgaagaaagtgaaatactgatgagtatgttaggatttggaaagaatgaagggaaggcatatttgcttcaggcatggcataaactcagggacagaaggcaggcaagaaagctggagggtatggaggaataaaggagcaccacaagcaggcttgggtcgggagggagcctctgggtttgcaaagatgagccatcactggagatgctggtgtgcgacagtggcataagaagcagtaggttggcatgaataatctggcactattgtgcaggacgaactggactcacactgggcatggtggttcacgcctgtaatcccaccactttgggaggctgaggtgggtggatcacctgcagtcaggagttcaagaccagcctggccaaaatgatgaaaccctgtctctaccaaaaatccaaaactagctgcatgtggtggtgggtgcctgtagtcccagctacttgggaggccgaggcaggagaattgcttgaacctgggagtcagaggttgcagtgagccaagattgcgccactgcactccagcctgggccacagagcgagactccatcaaaaaaaataaaaataaaaataaataaaaaataaggcttttgcagaagcctgggcatgcattaacaggagctatatttgtgacaatagagattagaaaaaagggacagaaggtaaagtatttcaaaagaagaattagtcagcattggtaactaattgtaaatgttaaaaaacaaaaagcaaaaagatgtcttccagatcacatggggaacaatgatggaacacctgccagaaataaggggcttaggagagagggctggccgcctggagaatttagaggacaagtttggctttgtgcttgtcaagttactgtttacagtggatgtctttctgtggtctgtggccctgaaaaagacatttcctccccccagttttaactttcagttaactaattattctctaactccttcacgtgtatctgctttctttcatatctcgctatctataaagtttataatcagctacagatctttgtacatagcagaacattctacagaacgttttgatttttacctccatttccacgaacaaaaataggctgaaatgtctttgattaattatggtttcagacgtttcatgtcctgttcataagaagcagattcgccatctttagatttttaggttagaggagggcaacgaaacgaacttcaatgtaaggcgggaaactaaagaatgctaaccttacgtccagaatgctgtttgctctcattccctatgaaccgattagaattataaagaggtgatttggggaacttttttatccatggttcgactgtaaaataaacaggctgatctgtgatgtgtggccagtggaaatcagttttattacttgttactcatcccgtggagatctcagttcagttctggtggacagagttcgaacgtaaaaacccacctcttcacataaaataaaatcaatgctatgagaaggaataaacttttggttatcattttggaaaaccaattttttacttctaggttgcatcttacccttttgggttgaattttaataagacgtatattcatttaaagtggaatagcgattctcagggtcagctgcttcatttcacagcaactaaatgtatcaaagtatgtcaaaataacatattatagggaagtgtgacccttgaaacctctataaagaaatggctagtagtaagtagttcagatcttttaaataatgtcattctaacaagaaagaaaatgtcacattgtttgtaactttttataacactgtaacctaaatgacactggtgttaggacctgagaccttaagcatttgctgagtgaatgaatgaatgaatgaatgaatgaattttgttacatattgaccttcaataaaaagaaagacttggggcccgaacatattaaagctataaagaatgactctgaattttaaaagttgctgtaatgaaattgacatttgttcaagatatattgcatcatttaaaaaagacatcccaatgaatcattagccaaagacctgcttttccataatatctttgcttctttatgctatcctcaggaattcactcttcattaccaaatcttccttctatttttgtcaaaaagtatattaagtgttaaaatggcaataccaatgcattgaaaatacctttcaaaattgatttgcacataattatatatgcacttaccttgagattttatgtttattccaaactcctgcccaatgttataaacctgaactacagagttcaaatgcacctgtcatttctttctttagtcctgacttactcttactacaagccatccagaagtaaaatcacaaactcttcatgggaaaaaggcacataggaccataatctaacaccccagtgtgcagtaagagatatgatattgaccagggagttttcctttttaggttctgttattagtaaatcattgcaagaatagacataaatatcaacttagttgtatttaaactttttcttccaaattccataaaaaagacaccaatttatcaaccattcctcccagaggccctttcatccatattccttagtcgacagttcttctgtgacaataaaatgtgaataaaatgcaggcagaaatatgtatcatgttctgggcagttagggggtaaggctttgaaagctcattaactggaacggttggttgtgtttccctagagaaaaccttcggaccaactgcaaacatttatcttctgggaacaaaatgggccccatccctgaagaggagaaaaggccagcattcttgacatgagagcatggtaaaggtgggattgcaaggaattagagacaaggctgctagctatggttggttaacatcacctaacactttggctcttgttaaaaaaagaaaaaaatcaaatttaactagcctgattgcagagtttaaaataaagagtcatcctttatagtatacttttcttattaacattcagtggattccgtgtagatgaaatagtattcatccattcgttcaagaagcattcttcctcaaggaggcaggtctctgagccagtgttatttgcgatgcacactcaaaaaatgaatcacatgggatgccccttggggcctttggcagcctccttcccgttaaattatcagtgtgagcattaattcaagatgtgaaacctcaggcatggctgtatcaaggcaacaaagcagcgaagaggcagattacagataacgaggaccagtcaggggttcagacaaacatggcaagcagagtttcagataactaaaaattgctccatccatgctgtggcactctgacaaatgaggtaaacatcgcaaatgagaggaagaacaaggcaagagctagtggctgtggctcctggagacatccactttcagcatcgtagaggtctttctagagatcctttctgtccaggtgaaggccatgcatgcatcaggacatttttggtcttatctcccaaccagaaagctctctcttacctgttggagaacctggcatcccactggggtcatctctcagaagatacgcagggtcctagaaaaatgagaaatgcaatacttctgttataacacaacttctattagaaaatgtagttccttttccagtttgacttacaaggagcatatttcctttcatcccagcagccaaaacagaggcctcctggtctcattttaactgtaatagccccaggagctttggctgcggtattttcccctgtcgggcccagatccaggattgggctagatattccacaacacaaataactgcatcctttccatgtgtacattggtgcaggctctcattaatcacttctggttcttcagcagtcgatgatgaggactctgcctcagccgtctactgacatgggtgatttgtcaaatagatattagctagaggagggcttgttaattttatgtatgtaaatatattctgaggacaatgccataatgagaatattatgatctgcaattaatagacattttctttagttattgacatgtcctcaaaaacatctatatgattatcatattcctttttataattttcttctctttttcttttttcttttttttttttattagacaggatctcactctgtcatgtggctggagtgcagtagtgtgatcatggctcactgcagcctcgtctttctgggctcaggtgatcctcctatctcagcctccagagtagctgagactggctgcagagtagccatcatgcctggctaattttttgtatttctggtagagaaggggtttcaccgtgttgctcaggctggtcttgaactcctggactcaagctgtctgcctgccttgggctcccaaagtgctggggttacaggcatgggccactgcactcagcccctgctttttataattttcagtgtgcagggatcacgttcttctattttaaatccctgctatgtctaatacagaacactagaagctatgaatgctgggaaaatgttggtaatgaagatgacaatagtggtaatgtggttaagtgtataatcactaattaggcaacactgtaattttctggttctgaaaatggcgcagcacattcaggaagactttttgcctagaggcttgtgtggtcctgagtgcacacatacatgcctggacgcatggcccacgcagagcagggcagcagaggcttggcagccaggagtctccttgccctctgtctcccgaggctcacagtatttctctttgcagggcctcgctaaggagtagctctcggctggcaagctgccacacagatttttataaaaaggcattttcctcatataaaataatttggggctttccagttacaccacattgctgtaattaataggagtcactttttacgtagaagatctattagcatcagtgccacatgaaaattaagaagagatgagaggccaacagcagagcaagacaaagatgagaaatcgtcttaaccacgaggaccacagatgaagagcacacgagcaaaaatggaaaaaaaaatcagagttttcctaggttatggaatatttggatatgagcctcacctttagttttgacatatcatattgaattacaagtgagagctggaaaaaaatgtgtattcactctattggaactaaaatatattttgaatattttctccttttcttccttaagatgtacatttcctcctacctgtacattaatgttcatgaaacgagcatatatcatcatttttaattatttgactcatatttcctcccttgtcattgcttcagtgtgctcaaaagcaggtgtaaaggaggaaattaaaatagagcattcacctgctgtgagtccctatcggctgtaatggttggatacgtggacttatccctaagtcccactccagtggtcaagagccattaaccaaagcctgtccctcacagcttccttcactctcgagcccggtgatgccctgtcagtcaccaggtggacaccattgtgattacacagaaagtaatttcttgatagtaactaacaagataacaatttttagcatactttgttgctttaaaggtatttcatggagagtttttgactacaagtgtttactttcctgtatgcagtcaaagtccagctgattgttgcattaaatgccctcactatccctcctgggatcaaatgagagaggacccaagaggttcttagaaacaggactttacaaagaggaggttctgagtatggcattgattctcaaaacttcagtttgcaaaagaaacagctaaaatgcagttaaaaatgcaaactcctggctcccaccctcagatattcacatatgggtaagtctggagggggcccaagaatatgcattttaaatgagtgtttcagatgatgctaatgcaagtgctctgggaaccctggtgtaactaacacaggaggggaggggcgtggaacttttccttctcctaaattcactctgcaagaggagatattttccgtactatgcgttattttgacaggttgccattgaggtgaggaagatagtgaatacttcctgtaaagagggcattatcatgtgagttcatactttcattcatacaccttttgcttcttccttggttctaagtaccagtcacatagataaaatataaaaagggacaaattttaaaacattaatcaaaagcaacttaagtgtgtccatggctaggaataaaccaggaactgaagctgaagtgagggtctactggactctgggtagagaaacagaagcaggtagagtttgcttcctacaggatgatgagggctaacagtacctgatccaacgcctggacccaagtcagcccctgtgtttgaaatcagcagctgggtcgtgactgaaaagtccagagaggaagttgggataaaaagcctgtaagctcctccctagaaagctgggtatctggggttggctggctggagcaaaggcagcctcccagccaagacttgagtgcagatacttccagacttggagactggatgtgtaatacacccaggttcatgacagaacgagagcttcaaggtgccaatacaagatctggttctgggattggggtgcaaggggttaggtgaatgaaggcaaccaaaataccaccaaacagcaagaggtaaatgaagagagacagagtcagggaatatataaaatactattcaaaatgtatatgcaaattaaaattaaatttataaataaaattaatgctgtgaaatcagtgtttggaagatgagttcactgcatatgaaatgaaaatgatgagttttaaaaaagtatgtttgatattctcagagtaataagggaagtaataacatccataaaagaataagaaattatgggctggacacagtggctcacgcctgtaatcccagcactttgggaggccgaggtgggcagatcatgaggtcaggagatcgagactatcctggccaatacagtgaaaccccgtctctactaaaaatacaaaaaattagccgggtgggttagcactcacctgtagtcgcagctactcgggaagcttaggcaggagaatcgcttgaacctgggaggtggaggttgcagtgagccgagatcacaccactgcactccagcctgggtgacagagtgagactctgtctcaaaaaaaaaaaaaagaataagaaattatgaaaacaaatgaaacaaatacagaatatataataaagtactactgaaaattctgaaaaatgattcttgaaatgaaaaacaatagataaaataaactctaggttcaacataattggaaaaaattatgttgacctgacaagtagtgttaaggaattccaccttatacaccttatatataagaaaatgaaaagattgaaaaaatgagagcaaataagaaacatgaaggatgaaatgatagtctacaaagtataatatgaacatcagaaggagccagttacacagaggagaagcagcattcaaggaaataatggttaaggatttttcagaactgatggataggcaggaaaaaaaaagacacttttggtaagaaaatataaaacattagggattcagagaaaaatattacagtaacctgagagaaaagacattatctattatctacaggctgggcacgctggctcatatctgtaatcccagcactttaggaggctgaagcaggtggatcacataacgtcaggagtctgagaacagcctggccaacatggcgaaaccctgtctctactaaaaatacaaaaattagctggacgtggtgtgtgggcctgtattcccagctactcaggtggctgaggcacgataattgcttgagcctgggaagcggaggttgcagtgagtcaagatcatgccactgcactccagcctgggcaacagagtgagactctgtctcaaaaaaaaaaaccacattatctacaaaagaacaactcccaaaccgaagtgttctcatgagcactgatggcaaacagaagattttccccaaatgcttttgacatagagagtaaataagtgccaacctagatttctattcccagctaaactaccacttcaggtataaaattcaagctcctaatggaaaggagtaaaatatcttttatttaataaacagtgcaaggggtgcagatccaagacagttcctatcttagaagacctttcaacctagtgagaacacagtcttgtaaacactaattataacaaatatcttaaatcacatagataatactgtcaatgagaatgtaatttactctgttaccacaaaagtgtactattgttggaatatgttagtatagtgagacaatcatagtagttataacaccatagttgaagatcttgtttattaccttttacacacagagatcatacaatatatttcttccaaatttagtttctagaaaaaattattcttgcaaataaattaatttcttcctttagacagtggcaactatataaaagtaacattttcatttttgctgtagttgctaggaaactcctagtcaaattttatgcctaattgtggtgagtggacttttttgaaatcataccagaccaaaccaggatttattttgctaacagtcatgttctctgctctctgtggatctgtcaaaatttatccctcattgtgtatgttgttaaattttgcaaagtactttaaatctatttggaaggggatactgtgattcatttcttttaaaagaagaactctaagtgaaatctatcattttaataatgagtatagaaaaaatactatgcttcacagaaaaattagtttttaataatttaatttcatgatgtgtgtgcacgaggaaaccgagctttatttttaaatgcatgcaattacatttccaaaaattaccatagcagtttgggtttgaagcaatggattgaagtaaatctttaaaataggaattctgattctaaacttgcatagaaatgtagttcactttaaaatatgtataatattgaactaatctaaggagatgtgtgaaataaatccttataaagtatctcaaagatctattgtgggactatttaaaagctttgctgtttaaataatatatgaaatattcaaaaatctctcacagacacatgcacgtgcacacacatacacacacacaaagataaatgtagataccaaattcacatagagaaaaaaggtacaaagtagatatcagctttacatttaattttgaatcttctatgactgtgacacagtaaaacaattttcagctcttcagttgatttcacttgtgctacttcgctagttttcaaccttcgttattgtgttgtctaaactggtgggtaaattttccaccttgaacactaataggtgacacactgttaatcagcataccatttcgaaatatcttaatgcccattaagtctatttttttccagaagcctatagatttcagatggcctttaacaggagggagaagaaagggcagcttttccttgcttctttagctgtgctttctgaccacagcggttttcaagcctcatggcacatttgaatgcttggttgtgtcatcattctggcactgttatctttgattccaaaagagaatgtagcatttcaaatgtcggaaatgtgctatagattttttggcagtaggaaggaagtcagtttgactttcatgtcttaaagaaatatgtaatgttatgaccaaaattagtactctctgaaattattttgctctgaaattggaaagaggtaatatacatctattaggttgtatacaaaccctttgactggcagccaggtttgaacatttctttttactagaaaccagctcttacatattcatttattcctttggcatgataagagagggagactgggaaggaaaaaaattgcattaaaaattttaaactaatgtaaagtaagctttattagcttagaggcatcatttccctctgttttcatatatgacagtgggtaaacaatcaagtgccagtattctaagtgtgctaaattgccaatatgtcaagaaacagaagagtttaaaatacatcaagatgaaataaattattgcttattgaactttaagaaaattatttcagagtgaaacttgacatgtaatttagctgcagttttttcaattgtgacctgttacgtttctgctttgtttacaccatatagagtgcagttatactgagctacttggagtcgtttaaagcagtttcttggcatgtatatcatcatcctgagacaccttataataaattcaatccccctgcctccccagcatgccatatgttaaattaattaaaaataaaacttttaaccatacttgtaaaagtactaagaaattgtctccactagaaagcacctggagcctatgttttagaatccctatggttagttgctataatatttgtgaaaatttgaataatatgggaaatgggtagtcttaattcacacaccaagatagaagttgctttattctcattgatgtctccatccgcatatccataatatgtttttattttcaacagctgcttaatgtgttattcaagttgagttgaggtatggttaagcttagtgatataaaaccttctgagacatctaggaatgtgatatttctgaccagctgcaaaaatggtaacctcttagaaacaaatgagcataataaaacaaaaagtaggcagtgagtgtattaatcttttttcttccttgtgtttttcctctcatattgctttcttaaaaaaaaaaagaaacctttaatagagctctaacctttaaaagttctttgagtcaagcaatttttcatgatcaagctgtctcatgattgtttttatttcagtttaacatttcttttgattcactacatttttttaaggtatttatgagattttactccagagttcaactgaggttaataactcgtgatttaaataaagtcattgaatatctgcatgtgaccaagtcagtaccactcttggggtcacaattggcttcccaaagtaactataacaaaattattctagatagaatttattgtaaaataatgagtctgtttatacagttatgcaaaacatgctctttcctgttaataataggaaaatatttcattgcttaagaaacaccaaacctgcaacagagtgctttagaaaacaaaccatcggagaggcacacgttgtctgcatcactgcctgcctcacactgggttttgatgttttgtcattcagcatgttgttgatacgaatgacaaaacattgaaatctaaggtggtcaatttacattttctttgttgttgttgtttttttctgagaccgagtctccctctgtcgcccaggctggagtgcggtggtgcgatctcggctcactgcaagctccgcctcccgggttcacgccattctcctgcctcagcctcccgagtagctgggattacaggcgcctgccaccacgcccagctaatttttttttgtatttttagtagagatggggtttcaccgtgtcagccaggatggtctcgatctcctgacctcgtgatccgctcgtctcggcctcccatagtgctgggattacaggcgtgagccaccgagcccggcctccattttcaatacagtatgcagatggaaaacaataatagcaattacattttggaccttgtttctcagtgatctttcatatgtaacattttaatatttattagtttctcactaattaaatataaacatataataccattgtagcaaaaagttatctaacccttttactattgtgaatggtatatccttgtatgacatgctttttctttattttttacttgcattctttttttgtagtttgctaacatcaacttttaggataatgatagaaaaaaattcataaaatacattgattatttaaaaataatgccaggaaggacttagtatctaataaacggctaaaagtcactttgagggggaaaaaattgtcagactggcatcctcaagggtcaagaagcaaagatgaaaataggtattaggacaacaaaagatactttttattcctaaatgatagttacattgttatagtatttaagtgaagagtgaaaatccacctctaggacgaaagctgaagataaagccaggaagagcccatcattttgctattttctttgtttttaacatagctctttgaagatgtagatgattgataacatgtttcatgatttacctaaatgtttgatatctgtacatctctccaaaatgaagatttacatttcaaaagttgaatttatgtctgaagatttatgtgtacgtggttttttaatatccctaattttgaaaaaaattctataatttggccctaaattatactaaaactgaatcatggtatcattacttccaaaacatttatctgtgcaggtgctaacataaaaatgaaagcatactttaagatttgccttggaaacagatgtttttgaaaatactggtgaaaaaaaagcaggccaaaaaagtagggaaacatttcaattcgaatatattgcaggttgagattgttgtagagagtggagtggctagagagagctaagcagtttctttgaggtgcagtttcacttttattttcaaaaagcaagtcagtataacaagtcaaggaagatagaaaacagctgaaaagaacggattctccagtaagcatcgtttatttaaccacggaattcgtaatgtcctttgcttatttagaaaaagtttctggaatttgccagggggtcacagacacagaagtgatcaaacctgcatgattgttggggggtggggtagtgataagaattttacaacctgtttccagcactgggggccctcaggggcaagaggaactgagaaaggatggaaattagatatagtgtttttgtttttgtttgtgtttttgagacgggcctcaccctgttacccagcctggagtgtggtggcactatcacagctcaaggcagcctcgacctccccgtgctcatgtgatcctcccacctcagcctcccacgcagctggggctataggcacccaccacaacaccaagctaattttttgtgtgttttgtagagacagtgtttcgccatgttgcccaggctggtcttgaacccctgggctcaagcaatctgcctgcctcagcctcccgaagtgctgggattacagctgtgtgccaccgtgccaggccaggtcacaggtcttaagagtgggatatgacttgctggggccaaggacagtgccatacctctcaacagacctcagatctgcggcacgttccgtccttagggttatgagtggatacgacaggaaggttataaacagaagatgataaaaatggttttggaaaattagttttcaatgctgacaattcggccttacaaagacattctatatatgaaattatttaagatctttattgttaatagtaattatcatagcaagtaaatacttcctgaacacatgatgcagactctgtactaaatgtgttacccatgatcttattgaacttttatataaactctgtaaaagaaatactgttatttctgacacttctcaaaagaagacatttatgcagccaacagacacatgaaaaaatgctcatcatcactggccatcagagaaatgcaaatcaaaatcacaatgagataccatctcacaccagttcgaatggcaatcattaaaaagtcaggaaacaacaggtgctggagaggatgtggagaaataggaacgcttttacactgttggtgggagtgtaaactagttcaaccattgtggaagtcagtgtggcgattcctcaaggatctagaactagaaatgccatttgacccagccatcccattactgggcatatacccaaaggactataaatcatgctgctataaagacacatgcacacatatgtttattggagcactattcacaatagcaaagacttggaaccaacccaaatgtctatcaatgatagactggattaagaaaatatggcacatatacaccatggaatactatgtagccatgaaaaagaatgagttcttgtcctttgtaaggacatggatgaagctggaaaccatcattctgagcaaactatcgcaaggacagaaaaccaaacaccgcatgttctcactcataggtgggaactgaacaatgagaacacttggacacggggtgaggaacatcacacaccggggcctgtcgtggggtgggggagggggaaggatagcattaggagatatacgtaatgtaaatgacgagttaacaggtgcagcacaccaacatggcacatgtatacatatgtaacaaacatgcatgttgtccacatgtaccctagaacttaaagtataataataataataataaaaagaaatactgttatttccctatttttcagggtgaggacattgaggttaacaaatatattcagttctatctagtaagctatagaaatagaatttgagtaagtctgcctgattgttataattgtgccctatctgtcaagcagcctcctgttttgaaggaatttctaattctcatggatatacatttggtgtttggagaggtagatattcgagttataagacagatgaaaatttgacttaatttaacacatttgtggccatgaaatgaattaatactggacagcggttgatgcagtttcagctactgtcactctgattactgtatgagcgactccagtcatccatagacaataattcattcataactttctctctcagtcaccacacacacacgaactacactggtgaagatttatttttgccgcatacggacataatttgagaggcatggcctccacgactcttctgtgaaatgacaagttttgtcaggaagtttctaggcctttatcagactaaaaatagaacatggctacaatttttccactgtaatacttactcagataaatcagttgaaagagattattaggctcagggccactaagggaaaactttagttcaactctggctgctgtgggggcagaatcctgtggatatgattgtacactcttagcattgacatgaggattgatgaatggatatacaccaaactataggtatgtcaaggtaggggctgttataaaaacatgctgggttagtcataatggcaaaccaataaatcaacagttggaaattctgttttttatttgacgcactcagaagacatatctccatgtggaaagatgaggagttttcttatgtccttatcattaattattccattttggaagccacatgcttattctatacattatcctgatagctaagaattgatatcagtgcaaagaaaaaaaaagtcaaatgccaaagaagtaaatccagttattccagagattgagatggtttcatcactgaacagcttgcagatagccttcagaaagtaatttctgaaatgtatgcaatgtcatcagagatgtgacattttaaaaataaaattgcactgatagactaatcaaaatccacatttctctgagccattgtatctgtcttcattgtcctcaccccctcttcatcttcatcttcaccctcgtcatcaccctttattatctcaccttcttctcattgccaaccacactgagaaaagtagatagagaggacactatctccaaagtaagtgagggcttagagagattaaggatcatccaacgtcactcaagtaagctaatggccaagagagcaataaccacagccctgacaatatatatactctttcctctagatcaacgtttctccccttatttcatgctttaggtatgactttgaaagatgaaataaatgagttgtatagtcttaattcccctttgttgctcagaaatatcctctgagcatttcccaaagaatccagaagagaagacttacttctgttagtaaatgtttagcctctggtcataactatcttcctgttttgtgcaagaagagcaagcaagaaagcaaaatgtgacagggagaatcaaagaaaactcagatttctgctctcacatttatatggatcagatctatttttatatgtattaaggttcttttaaaataaaagaaaataaaatgaaaagagctgtgaaaaaaagaaaaacaatctaaatgctgtctaatcaataaggaatattcaattcttgatttgcaacttagtccataccaactagccaaagtcctcccaaccatgacctcaggggctgaaatggccctttagatctaccaggttcttgctggagctcatcattcgggatgaccattggctgaaggtcaagtcccggggccagctttgcaacttggcttttacattaggcagtttccgtgcgaaatgaatcccactgtggttagaaaaaaaactgttttgagataaattctgaaatatttctggtaaaagacctctcatctccaagctcagtcttcctttttttctgtgttaaaactatttgtaatgtaaatgtgttcctgtgtcttgaaacatctctgaagccacgcaaattcgtatcatccaataaaggtgcttatttatcaacggatagctacacatttttttcactgtttttttttaaaagagtgtagactgtagtgttagaagttctaaagccaagcaagcagtgggctgtagtgctttgaaaacggcatcatgaaatgaagttgcatctttagaaagcaaacacattagctcggtggtgacatggaaggcgtaaccgcgttgttttgacctgttgtcacattgacattccttcttctgttgttggctttgagtaacctcgcaaccaagtccctgctgccttaaaaattaattatgataaggatttcttttcagttcagactgttcaagaatgcctcacgtgcaggctgcaaattatgaagtgtaaattagggcatcactgagcagggaaggtcccaagaaaccaatttaagaattctctccggctttactggggacctggaaatagtcccttctgaaggaagaacttgaaattagaatcgacttgtcattcaatttcactgcatattgggatcaacctttgggaaagaatgtactaaatatatctggacaaaaattttaaaaacttttttttactgcttattgtacagttttcacagctttacttaaaaataatcactaccagttttcagacacccttgtaagcatgccacatgtatattaactcacttttagcaattgtatgaaataggttttattattgttgcccccttcttccagatgaggcaactgaggcatggaaagtctaagttgcggagctcacggagctcgtaggtagcaggttggtctccatccagaggccttgttcctaaccttgaaatgacactgcctcaacaactggactccgtttctgaactcttctttcttccatttacaaaacggatggtagatagatggtttttaagctgtgatccataaaattaatttgttttctaccttccaaaatttgtcaacatctcttttctgctgtcgtggcctttcctgttcggttttgttcttgtgtgtgtacgtgtgtgtatgaattttttaaaatttctttactatcattttcttttcggaggtctgctcaggttgtgtaaagtattttgaaataggactttaggaagagaggtgctggagaagaaaaagaaaatattagtcactccttcacgtctttaaaattcttttttccagatcaccttatgtttgtacaagttaaagttgaatctcaaatgcctctgaatatagtataaaagttttcacagctgtggtcaatatggttgcattattctttccggctctttggtgatgtcctgtattaaggatgtagtgttctgaaaaattgtgctcactcctgagactttaaaaatggagtcaacaaagcccaatgacttttagtcaacaaagaaactaaaagttagaaatgagcactagatgagagaacaatgccactgtaaaatactcttttttaaaaaaatacacgcaaagcttcatatgttaataccccaagctccaagatggccaatttatttttgaaacaagaaacacctgtttattatcaaccataacaataatatgtttaattttgagagaatctttttggcagttgttaataagccatactgtaagatttaaaatagttttaatatattctaatggacttcttataaggcatgagaaaatatatttagatgttttctttgctttcacgtaagttcagcattaaacatatgccttccgttaactttagtcattatttcaccagattgtacttaatgaaaaaaagaaatttaacagttgtgtcactttatcttaccgtgttctgtaactcaagggaaaaactaagacaggattaacagtgacccacaagtacagtatatttttgaaaaagcagttttcacttgtaatgagtataaactaaaacacatgggaagaaaagaatccctataggtaaaaacctaagaatggtcattcaattctacttcacttagttgactggactaattttttctgtattttctttggttgcagtatctacaattaaatttaaaaagctaactaaaatttaaaacacatacacattaaaattagcaattcaactaggagctctttttgaaaaagtgaaaaagcaaaaatataaatgtaatgtttgttataaatttgagcattaaagtaccttaataaatctttaatggcaatttgcattttgatctttcccagatttgagtctttcagttaaagtcactctttctagcatttaccccttagaaagcaaatattgaaggaaattatcttcactgttgattttgattttttacacttttttttttcatttttgactattactatcatctctaggttgggcctatttttttaaaaaaaatgtacatgaccaaaaatatttaatgtaagaatgtttcaagcacatgtttaatatgaggactttgcatcaaccttgccaccatttaaagaaataatgcatggacaaaatcatacaatctgcctaaaacgaactaaattggcctctttttaagttaattccacggaaaagtaagtgtgtttgctagcggcaagatagggtatcaccatctttgtccctcttagttagccacagattattttatgattgttttaaagcaattgaggttaaaagaaattaaaagggagaaagagtagtaatgtagagaaaaatgctgtttttttgaactaattaaattttttgctggcattatgaaatcttaaaattatatttaacctcactagataagccccaattgagtatagaactattacgtaaaaactgacagttctctttgtgatgacatggtgtaatgtagaacaagaaagattttttgagatgtctcctcaaaattgaatacttgcacatcgatccttattttcagattgtatgagaatgtttatttttgcatttgtgactggtattaatgaggaaaatagtccaaggaaaaaactatatgattcattaactctttacttttcactccatcctagctgctgtgctgtttaaaaatggcttcagaagataagcaacagttttaaataatttgggtgattatgttggactccattatagtctctggagcaatatgttcattatttttatttctccaaaaaaagtcaaacaacaacccaaattgttctggttgcttaagacaatgactggaagcatttgtatttcctatatatcctaaatgctgagatctggtctaactcatattaacctcctctgtaaggatcacaaatcttcagataatctcctgtatcttagtaatttattttctgtcaaacatataaaacaaatcatgttaaaacattccattaaaaagggaggggcttggaggaaatttttccgttgtagtatgtgctgccttttctggagttcctgatgaaacacagatgtttcaaaagtgcccacaaggatggttagccatgatcagattgatccctggttactctctgaaacattgtgcttccattctttgtatcaaaatatattgccctctttcgcagaatgaattcaagtgaattttcaaccaaaacttcaattaaaaacactcaaagtgggctgggcatgatggctcccgcctgtaatcccagcgctttcggaggccgaggcaggcggatcacgaggtcaggagatcaagaccagcctgaccaacatggtgaaaccctgtctctactaaaaacacaaaaactagccagacgtcgtggcacacacctgtaatcccagctactcaggggactgaggcaggagaatcacttgaacccgggaagtggaggttgcagtgagctgtgatcgcaccattgcactccagcctaagagacagagcgagagtccatgtcaaaaaaaaaaaaaaaaaaaaaaacactcgaagtagaaattggaggtattagaatttttataatggcttataatgcatttcttcccaaaacgttctaaacataacttgtttgggagtaaatgtctcttttgactttaagcagggccaatatttacatgtgaaccataagttcagctcttgtggatactgtgcaatattctacagtgacaaagaaatcagtttacttgagaaagtaattggttgcgtgggtagctccttccaaaggcccatattggagaagaaccactgagaatgtagtattctatctagtttggaatctttgactttgaaaaactaatgaagaaagtatatgctatactagaaaaattctaaaatcaaagaaacaacctaaagaccattaagatagcttctaaagacaatgacggaggactgccattccatccttgatacttatgcagatctctttgcataaatataaagaaaaatgtgagtgaatgacttttcaaatcatcttgattttcttttcaaatgaccccaattagcaccatacttttattagaagttaaaatcaaattgggactaatctagtcattaatataaaatagttgcatgtatttcagaatatttaaactgtatcacaatatttattgcaatgtctttatatttttagggcccagatcatttcctttagctaatactgtataaaaacctcttattattccattatccagcctgataaggatttttaaatttgatgtgattctgaacctacagttaatactttgacgagtataatttaaatcataactaattgttgaatttatagaataaattcccagtctttccagacagaaattatagtacccctgtgttcattatctgttgaaaaatattgaatttctaaacatgtttccaaaatatttgcctttcagttttgcatacttgtatttctaattttcttccatgctgaggcatctgttcatgatttctagcttattttcaaaatctttttgtgttaatgttttggatttggtattcagattctttatgtgctgagggacttctggagacctactcacaataatgactttttggattcataaatttaactccagtataaacattattacttttttttcacttgggaaaatattcaactttttacttctactcattaaaccaaatctgtgttgttacttttgtttgttttgtctttacactttggacgttaggatatattaatggctgagatcacatttgcagtctctctgaaaattgatttttaaaatacaattctgattccagaatacagagggaaaactttacacgaccaaaagggagcttttgtttgttttagggagggatagtcatattttgagagaaacttatcctttcgaagagcaaggaagctggattccccaggatggaactacttggctctcttttctgcaacagaattgttgcattaaggtaaaagtcaggctgcggttatatgcattttctgttaatttactgaaaaatgctctccttccatttatattctttgtaaactgcaagtctaagagataatatatgttcccatctttatctatggctatagaaaatgacatagataaataccactttgtgctaaaaataagcctatagtaatacagaggtcagtcttgagtcatgcggtacacaaaacagactggattttgagtcatggcatctacacaaaatgcaatactgctgaatttttatattaagaggctttggctgaaggaattcagacacatacacagtatggacccagaaatcttgccaagaaaagttgagttgaaaatgtaggggaactgatccaagaataggccttaaacatgttgcatccattactcgcagctgtgtacatgagaagtgactttttatcccacctcccaaaaccctatccagcactgtcacttttttttttttttgccaacttgctgacctttctgttcccacaaaaggaaaatgtgattatttaaaacatttctgcaacaaaaaatgcatctaatgtatttgctataaatacaacacatttttaaagagaaatttcttataagttcagttttgtgagtaaatagtaattaatcaaaggtgtggagaaaaccaacctggattcagagagctaatggatactgcattaggtgcttttggaaagtaaagatttagaggaactccggttacttaagtgataaggaattattataaaggtacttggcaaagaaagaaaaagccagaaatccatttcagtagacctggaagaaatgaatgtcaatcaagacatgtcaacaattgttcactcaaggaagtgagagagcataaagagatgccataggtacctcactgtagccacctgtctagttcccatgtgctttgcttctcctgcttacgccaccactgctgactgatgttcccattttatctccacgttcactttcccaaagataggatctgatcaatttgatgagtctttatctagtatagagccagatcattttatggatgccaatagttggagttctttggtcagctattgattccgtcagtcaattggcatccaagttacaggagtgatgccatgaagccaagcagaaaatccaaaaaagtggcctttggaaggccttgcttgacttgtgcagcccctatatcttaaccataaatgtatatattagaataataaaaaatatttcgtaaaatataaggtgcattttaaaaataccttattttgttaaaatttcctagcacagtattttaatttctccaagaaataatataaaaaaattaaaagaggaataatttgtatcattgctattttttctgtctctgatggtaactaattcttactgagggtattgtgttgatataattgcttctctgttccagtaagcataatggatttatcctgttttatgtgtgtataaatatgtgtgacatacagggggaaaggtccagtatttcccagtgttaggaaatatctttgtttgtctattgacctaactgatcctaaggtagcttcatccaaagactcccaccatttccattatttttgtgggtgatatgtatttgatgattttagaactgttgataatcacaaacaggagacttacctttttgtctcccacactcaaaaagtgtgatttgccaattcacacacaactaaattgtgacagaaataatgacattattgaattagagaagaatttaggaaccccagaggtaatatcataggactgttaaacattatttggtattattggatataaaaactaactttaatttttatttgtatccatcaaaactgcttaatttttataacttttaaggcagtgtttatttctgctatatttgattgtgaagtttatttgcctacacatataaattgcataagcaatttcttctaaatgtgttgtagatgtttataatacaaatagaaatacttaagtacttattattacttatatcacagctatatttaaaattctttagatccaatattagttttttactaatttattgcctaaaatgactaattgaatttgacatttccattaatgccaaggagtaaaactgttttgccataacaacttaaatgaaattcaaatgattagttttgaagtttggaaaatttctaaatctttattaccatggaatccagtggtcatctaacagctgcagttgtattaaccatggtaattcaaaattgccacaaatttggttcaggtaccaacatttatttactcagtgcttacacatagtaccataagagattgaacgatgaataaaataggaacactgcctttgagatcttactagttcagcactgtaatagctatgttcctaaagtatctcatttaatacaacttaaaacaatccaatgacatgcgtatattactcctattttacagacatatttgaggctcaaaaaagttagttttctgaaaattacacatccagaaagtgtaagaggcagaatttgaactgaagcctgtctgactcctgcgtctgtggtctttagttttcaccattcttcaatgcagtattatcactgagtgacatgacgcagctgtgtttgtggtcgggaggataacataaggcagcaggtggaaaaaacatttgattcatttgcatttgctagtttatcattgtagagaaaaatgttattaggccacttcttctgcaaagaggcaaggtatatttgaggagcagattgtagcacacttaaaaagaacgactgtaggccgggcgcagtggctcacgcctgtaatcccagcactttaggaggccgaggcaggcggatcacgaggtcaggacatcaagaccatcctggctaacacggtgaaacactgtctctagtaaaaatacacaaaattagctgggcgtggtggcaggcacttgttgtcccagctactcgggaggctgaggcaggagaatcacttaaacccgggaaggggaggttgcagtgagccaagattgtgccactgcactccagcctgagcagcagagcaagactccatctcaaacgagaaaaaagagaaagattgtagagtgggttgaagaaaggcagtagattaagattaaaaagaaagtccagtgcctgaaggcacgctgctcatgtgtgtcctcctaaggatattaggtttggctttgtcgatcacaaagcagagatctgagcaggtttgtgtttttgaaagataactttgggctgggcgtggtggctcacgcctgtaatcccagcactgcaggagccgaggcgggcggatcacctgaggtcaggtgtttgagaccagtttgggcaacatggtgaaaccctgtctctactaaaaatacaaaaattaactgggcatggtggtgggcacctgtaatcccagctactcgggaggctaagataggagaatcacttgaacccaggaggtggagattgcagtgagccgagattgtgccattgcactccagcctgggtgacacagcaagactccatctctaaataaataaataaataaataaataaacaaacaaacaaacaaacaaataaataactgactttggtagcatggaaagggggtactgatgaggtgagaaaaggggagacaatgaatatttaggatgctattacaaagaaccaggtataaggtgataagggtctaggtctggatggtgctttcatgaatagaaaaggagggatgaggccgggcgtgggggctcatcctgtaatcccagcactttgggagaccgagacaggcggattatgaggtcaagagttcgagaccatcctggccaacatggtgaaaccccatctctactaaaaatacaaaaattagctgggcgtggtggcacatgcctgtagtcccagctactcaggaggctgaggcagaagaatagcttgaacccgggaggtggagcttgcagtgtgccgagatcgcgccactgcactccagctggcaacaaagcgagactccctctcaatacaaagaaaagaaaagaaaaggatgggtgagattcaagacctaactaaggaacaacagaagcatcaggatttgataatggattttacgtaggacttggaggaaagacaattgaaatttctaccttggttaactagatggagagctatgtgaactgagacactagggacacggggaatgcctgcaggggtcagggtggcaggtggcatttgactttggatgtgtcgcattagaattacttatgagtagccacagtaagcactggacatcatggtgtaatacaatcagaaatgaagagccagggccgggcatagtggtttacacctgtaatcccagcactttggaaggccaaggcaggcagatcacctgaggtcaggagtttgagaccagtctgggcaacatggtgaaaccccatctctactaaaaatagaaaaattacagagggtggtggcgggtgcctgtaatcccagttactcaggaggctgtggcagtagaatcgcttgaacctgggaggtggaggttgcagtgggccgagatccgagatcgcgctactgcactccagcctgggcaacagagaaagtctcaaaaaaaaaaaaaagaaagaaagaaaagaaaagaaaaaaagtaagagccaggggaatacaagagagaaagagattaatgttgattaattggtccaagaaggctttgagaagaagacgacatgaaatgccaaagaatagataaaatttctacgtgtaaaagttgagtaaaaaggcatttaaggtaggctaggaattcacaatgtgttttatgttcactattttgttggacatcaacctaaatttgcacccattttgatatatttttgttataattttctctgacatgcagaagtctttacattggattgtagtcaggttaaatgcttttgtatatgttaaatgctttgcatgatatacaacgttattccaccaacattaaaccaatcatgcttaacaatgtaaattatttttaggacaatatgtacaatgtaataactgctgtgataattatgttttcttcatacagtgaatatatacaaaagccaagtgatgaccaaccttgaggggacaggaaagatttcaggacagaagaggagacatctaagttaaggcatgaaggacaaataggtgttagccaaggaaggatgctcttccagacacagaggagaaatgtcctggccaaagtggtagaaaccacggctgaagccaaaactgcaaggagaggcgaggccacaaaggatcttacaggccctactaaggagcttggatgttatcccaatggcactggggggtcatttacagttttcaaatttttcatcagggaatggatttgggtgtgtgtgtgtgtgttttagtagagatggtttcactatgttggccaggctggtctttaactcctgacctcaggtgatctgcctgccttggcatcccaaagtgctgggattacaggcttgagccactgtgcctggccaggaagtgaataggatcctatttttaaacaggtgtttctgaatgcagtgtgaagaatgtgttggaggaaaacacaaatagaggaaggtatgatactgcattcaagtgaaagataatgattgcattagcagaggtagtgattgtggtgatggaaaatattttgaatctaaccagagggcctgtggatagatttcgcatggtgagtgggggaagacagtgccaataagagaagatgttggagaatggcatctagatattttcctgagcagttaagtggatagagaggtttcattcatggacgcagggaatgcaggatgagatacgagtttgtggaagaggactatttcagctttacaataggtgcttgtgggacatcctacagaagacattaaacaattggatatgagcctggctgaaaaccgaagtcatggaatagcataatttgtgaggtaaaccttggaagatggcagtgattatgaaagtcagagacaaagaaagaaggagacagaagaaagggaggacgagaggaagggcagctaagcaaaggaagtgacgtgatgtacagagggcagaaaaagggtaggggcatgactgagaaaaatcacttcgtcaagtgcaagataaaactcgagtggtctcctgaaataataggctgaggaatgggagttactctcaagtcagtagcattcaatgaggatttgaacatgggaggagcatttgcaaatatgtcattaggaagatttaactagaatatgggttggagtgtgaatacagaggccatgtaatagattattgagatatctaggatagttataatgagatttttgaaggagagtcattttgatggctgggtggcgtgatggctcatgcctgtaatcccagctctttgggagaccaaagtggaggatgacttgaggccaggagtttgagatcagccagtgcaacatagtgggaacccacctctacaaaacattttaaaaattaggctagcatggtggcatgcttgtagtccctgctgctcgggagactgaggcagaaggatcctttgaatttaggagtttgaggtcgcagtgagctaggattgcaccattgcaatctagcctgggtgacagaacaagaggctgcctccattaaaaaaaaaaaaggtagagtagtttcagaagaagtaaaaagaaaacatggatggaacagatcattgtgaaaatagaagtgctacaattacttctcattgaacatggtgaggaccgggaaaggaggtgactgagaatggtgataaccttgagaaaaaaaggcaaaatcagaagcaggacctgtttttggaaatatgtaacttgctctgcatgtagaactttatagttgtacttcatagaattaaaattaaataatagtatagctggctgggtgccatggctcacacctataatcccagtactttgggaggccaagatgggtggatcacctgaggtcaggagttcgagaaaagcctggccaacatggtgaaacaccgtatctactaacaatgcaaaaattagccgagcgtgatggtgggcacctgtagtctcagctactcgggagtctgaggcaggagaatcacttgaacccaggaggcagaagttgcagtgagccaagatcgcaccactgcactccagcctgggagacaaaaaaaaaaaaaccgtatattggtatactttatttttaaggttgcttttttctgcttgagcttatcaaattgcaccccagagattattatcagggtatatttttcttttaccacacactacaagagaaaaaagacttagaaatccattcacaaggaatctccaattagaggaccggtaatctttgccaagggtgatgattggtcatcttggctaggctggacctctacggagaagctgaaagacagccacacagctcagcctggggtctgagcatatcacttcagcagtgatcaacagaacaatgagtacaggaaaggcatggagcatttccacgggaattgccaggacacaagttgttcttttgctggcatctttgaagtctataaaaatataattctggaaatatcccaagaagaatctgatgcaaagtcaaacacatcgagaatgctagatgccatttccatttaagtaactgtccgttctgggggtgaggagaagtgtttgtcatagtctttgctggtggtctctccggttccacggttttatggaagttacggttttgttcagtagagtcaattctccctgccagaccactacagagagctattttccttcaactgtattgcttcagacagtctacaaatatggtgtttattacatgacttcttctatcttaagtgtttatactgcaggtgaattttttttcttctgtgacttgacttgtgagttggttgttattgttttcctttttcagcaagtctttatgccaggaaaaagcgttttgattcccaacaagccaacaagaaaaaagacgggggatcctagcctatagacccaagtgttaagatgctttttaagagaggggcaattggaagctgcttgtaatatggagattagatattctgtctccagcatgggaacagggctggcatcggtgaacaggcaactgcttgcctgcctgcctgccttccttgggccagataaaggcccagaaggagcagctgccagccgggaggaatgtgagaaaataggaaattgatttgaaatagaatagggaaaaaggcacaagaattaatttaagaattttcaaagattccctttttaggcatatgtagttcctgcctctgcagaggaaggtgatctttagctattttctcatgagattaaaaaggcatcaaactcacagttagtacatacataaggaagacctgaagttggtttatttctccataattggaagaaaattgaatatagatttatattttactctttggaaagtcttgttgatccttcagaaaaaaaaaagaaatggcatattataaatattctaactctaggcacaggaaaaatagtgctttttttttctttttactagatacagtgatattaattaaatttcacattaaccagagggggctggacagctttctgtttgactgtgaaggtcgtagggactctcattttctattgacagcagttcctttgctttaacagatgcctttaggcatatcataatgtctctctccacttctttgcttaagggagtatggggagtcatgttaacaatatttaggatcactaataagtaagggagatgtttcccttatccaaacggaccgagttccgagtgcgtaaccctgtgaataggatatcctgggagaacatcatggaaggggcaggattcacaacgactgcagctttgtctgtcttcggggtcatactcaccagctgccctgtgagaaggcaggggattgagcagtaagcttcgagttccttttaggttgcagcatttggtggtgctgcataatctcttctgttaggaaactggtgatgcgctctaacgtgtgtgacacatacaaagagcctcctatttgtggaacgccttatttcaagttgttgataagacaccgaatcattggaaaagagagatcttgcaaagtatgtacaccttcggtaggaagaataaaagcacatgatatggctgtggttagatccttgccaccaccaatttaataaacatatgataatataggtcacacacaccttgttacctctcttgacttctaaaaaatgcaccagtgcaattcttggccaggcatggtggctcacacctgtaatcccagcactttgggaggccaaggcgggcagatcatctgaggtcaggagttcgagaccagcctggccaacatggtgaaaccccatctctactaaaaatacaaaaattagccaggcgtggtggtgggcacctgttatcccagctactagggagtactagggaggctgaggcaggagaattgcttgaacccaggaggcggaggttacagtgagccaagactgtgccattgcactccagcctgggcagcaagaacgaaactccgcctccaaaaaaaaaaaaaaatgcaccagtgctattctcatgaaggaaagaacttctcaacttctcacctcttaaatgcattgaaatgtgcctactatcttaacacaccaaatgttaccatatggggtagaataaagacaaaaatagctgttctctaaatcgtatatgcattaagaagttaacatttggaaatagctgagtgagcttctttaattcattcttcaaaataaacaaaccaaagcttgatctgtaattttatagtggatagataggcaacaaactcaggagggtagaaagggaaaaaccttaagaaaatgaatgaattttaaaatacagctactgaggccagccatcgttgctcactcctgtaatcccagcactttgggaggcagaggtgggagaatcccttgagcctaggagttcaagatcagcctgggcaacatggcaaaaccttgtctctacaaaaaatacaaaaaaaatagctgatggctggctgggtgcggtggctcatgcctgtaatcccaacactttgggaggccaagtgggcagatcactcgaggtcaagagttagagaccagcctggccaacatggtgaaactccatctccactaaaaacataaaaaagttagccagacgtggtggtaggcgcttgtaatcccaactattctggaggctgaggcaggagaatcacttgaacccaggaggcagaggttgcagtgaggtgagatcgcaccaccgcacttcagcctggatgacagagcgagactccgtctaaaaaaaaaaaaaaatatctgggcgggcacctgtagtcccagctactccagaggctgagatgggaggattgcttgagcccaggaagcagtggttgcagtgagccgagatagcaccacagcactccagcctgagcaacagagcgagatcctgtctcaaataaataaataaataaataaagcaacagaaaactattatcctaagacattaaagaaactggaggaacctcctggatggccatttaaaggttgcaagtgatctgagagatttctttttagagggaaaaaatgagacccagataacttaagagttaccaaggttacacagctggtcagaagaataatatcctgaacccaggtttcctgatttctagagaatttatagagaagtagagaaattcttgaagggtgagctgtgatgtttctttgctcctttagtgtgcaaactatttaagctattttgtttcttttaaattattttattttgcagtgagttcatttttatcatcaactgcagtgaccattatttaagtagtctaaagcttaaagatatctgcttgtctgagtttcagccatgcattttcctggcgctggttatgaaactacatgtttttattaaagttggtagaaatcatcatcacgcaatagagtaagcttttttatggcatagatgcccagaaataatttaaggcctttctcactaatcataaattgctgttaatcagaaactgacttgttttttttccagttagaaaattcctcattctagccatccttatgaaaccctgccagaaattccttgaaggtaaatttgcccaacaaccactgtagaatacaaccaaaaaagatgcagttattcaacatacacttgtacctaactttgagaacatttttacttatgctggctgcttatatcatctgtactgaggctatcttagactctgtagttaaggtgacatagtgatatattgatctaatgagtaatattatgaaattaattctaaaatactctaacttcttctgccttaatttttaaaattcatttgaatgatcacattgtacaaagcttttgttgaaaatcttgcaaaggcctttggccaaaaataacatagttctacatatttttacagtggtttctatttcagtcaaatggccaccaaggatgataggctctgaaacatctggatggtccagtgtcaaaatctacacgtggacacttgcctttgtggtcaggatcttcagtttgccatggcctcaggagttacatttaacttgctcagcatcgattaatagatgcccttattttgcctttcaatgactccagatcttttgcaagactcaattccctctgtacagatacatctgtgaagtttgttatcactctgaagctgaaagtccccaggactagacagtaattgagttttccttacctgacagcctctgactctacctgtttttcactctcccttctctcctctttttagagaactctcttctcctatattacttactgtgtatgtttctatgatttcccttaagctgctgaagttgcccctagcaagaccctaagcacattggctttttataaaccaagacagaccctaggtagaaatttgcctaaaagaatttgtatattttttcctacagggtattttaaataatggaaatacggttttctactttagttttaatctagggatgtcctgtgacgattaaacaaggcatttcatgtgaaagaacctaaggtgtttcaggcacataataggcattcaataaatgtgagaggaattcaaatctagaaggtttgaagaaaaaatctggtgtgtaaactagctgtctctatttccccaccatccacttggttttcaatacccattacctctgacattcaccccattattctactagaattattctcctttagatcgaaaattgcttcttcctgccaatttcaagaccttttcttcaatcattagaagtattaatctgtaacatgtatctttgttaaccatcacccacaccattccctgtcccaattcttgaaatctctacttggggcttcttcgtcgttttacactgcagattctctccaacttcccagacggtgccttctgtctccccattgggtgaacttcctctctctggcccctctatgtaagcatccaccaagattccagcttggctggttgctgtcttcgtttactcattgcctctgaaatctcatctgctctcgtaagtatcactgttagggaaccaggttagtaaatctacattatagaacgaaacccccttcttccagctgcaaactcctggtgggcaccttttttttttttttttttgacggagtctcgctctgttgcccaggctggagtgcagccgtgcgatctcggctcactgcaacctccgcctctcgggttcaagcgattctctgcctcagcctcccaagtaactgggactacaggcacgcaccaccacgcccagctaatttttttgtatttttagtagagacggggtgtcaccatcttggccaggctggtcttgaactcctgacctcatgatccacccgcctcggcctcccaaagtgctgggattacaggcgtgagccactgcagctggctctgatgggcacctttaaatacagatagccaaagcaatgctcacttcactccatttcgtttctctacgccatttgtcttatcatagagctttctactcttcctgggcctacatgtctagatctacagcctgatgactcaaaggtgatggttctcagctacctccacccccagtcctacagaggaagttcagagaagagcctttaagaagatgaaagagatgaaaaacagacccatgaggaaatggtagtaataatgagtttaacatgacgatgtggattttaagggaagatttgagaataattatcattaagtatatgaaaggtccttattgagaaaatggtgaccagctgctcctcacttctgcggaagaccgtgcggaaggcattgagcataaattgtagctctagaggtttttttttttttcgacttttatttcaggtttggggatacatgtgaaggtttgttacataagtaaacacgtgtcacggggtttgttgtagatattatcccatcacccaggtattaagcccagttcccgatagttaccttttctgcttaagttagagactcttaaaatagaattgccctcagtaaacaatgtaaaacattgtaatgtattacttggaatggctatggcacggaagggcttttttttaaccaaataaattcatctgtgtgtggtgtaatttagactggattatatctgagagcgatctgggagggtatcacaaaattagatcatgtattaagtttatgttcggttttataatcctgtaatttttataaacaaaaaatgtatgtatagatttttctaaaataatgaccttgaactatcaatggtgctaggtgacattaggtcacagcctctgccctcgtgaggtttatgttagcttaggagtatgtgagagagacacagacagacagacagaaagagaaaaagaaaacaataattacagaatagtgtgatgtatacataggaaagaatcattttaatcagcaagcaattttttaaaatctggattcttcatttccattgacccatccattcatccatccatccactcattcccaaaccagcatttattttatttattattattttttgagatggagtctcgctctgttgcccaggctggagtgcagtggtgcaatctccgctcaccacaacctctgcctcccaggttcaagtgatcctcctgcctcagcctccctagtagctgggactacaggcacgtgccaccacgcccagctaatttttgtatttttagtagagatggggtttcactatgttggccaggctggtcttgaactcctgacctgatgatctgcctgcctcgaactcctgaccttgtgatctgcccacctctgactcccaaagtgctgggattataggcgtgagccactgtacctggcccaaaccagcatttatttggtgtctcttttgtgcaagacactatgccaaatgttaagaaatcagcaaagaaatcgtccctatgctcgtatgttcgtggtctggaaggagctacagacaagtagacagggagcagaatatagtacgatgaaggcaggaaaagagtatttacggagctgaatgggaatgcagaagaggggcccataaactattcttggtgaatcaggcaaggctaaatggaagaactgacttctaagccaagttatgagcaagcagaaattggtcagctaaaatgcagaggtatggagcatgtacttcctctatccacaatgatgcataaatatatgtgcatactcataaatcgtgttcacaaagtcagaaaatcctgaaaaacacattctatatgactatatcatgaaaacacctgaaattaataattattatctaaatttatttgtcaataaagatatgttaaactatttgcaaaaatatcttagtacatatggattcttttgaaatggttgatattataaattgtaaagggttaatataaaagtttgtgtgatttctatgttctgtccactgcataaaggatttgatctatgcacggctattgccactatagacaactacccatctgacaacaccactgcactagtcaccaatgaataattcttcctttctaaacaatcaaaacaaagtacttatagtaatacatttaatttcaaagatttttgacattcaaccaaaaatgcttggtctttttgtttgtttgcttgtttttttagagatagagtcttgctttgtcacccaggctggagtgcagtggcacaatcatggctcactgcaacctccacctccgaggctcaagtgatcctcctgcctcagcctccagactaactgggactacaggcatatgccagcacactcgactaatttgtgtgtgtgtgtgtgtgtgtacatatgtgtgtgtgtgtgtgtgtatatacacatatatatacatatatatacatacatacatatatacacacacacacacacacacacacacacacacatatatatatatatgggttcttttctgtagagatgtagtttcgccatgttgctcaggctggtcttgaactcctgggctcaaatgatccatcatctcagccttccaaagtgttagattacaggcatgagccaccgtgtctggcctgagaaccaacacaagtgttttgggaatgggtgaatggaatgatggttggaaacagatggtccagattgaagaatttgctccataattaaaaacaattcaatcatctttatttatcacacttccatttctttatcttggactgccaaagaatacattcaaaatactccccaaaatgtattcatattatcaaagcctaaaagtcaggtgaaccccaataagttgccaagcatagacacatactgccatccctgggtgggcctaggaattagtgtgtctgcagcccctgaatccaatgtgccagggataagcagcactccctctagcttggccactcctgtccttccctagtcatggaggttactgataaaactaggcttccatatacttctctgtgctatagattgtcttctaacattgttggacacctgatggcttgacttgggttgggtcctcagctcttgctacgtactcagttcctggcatccacagccccagctaactcttgctggccatctggatttctcttgaagctctgccctcctgcctctctcctgctctcaccaccaggtaggaatgatgtccctacctcacccccttccctcctacttggatagttgccaggacaggactgaagctcactaagcctttcgtatacagcacattgcttgactgccccctacaaagagtccagacctcatcacacacacccagatcctgcttcctcctcctccctgcctgcccaggctgtagaggacccagtaggctcctgcccaaggtcatctgaattaggacaaaattaaggaccagtgcttttggcaagcagtggacatgattggatatctaaagaaagagccctaagtcttcatcatgtatcagattccacaaagcatttggtttttggggggtgaaataatttaacacctttaaaagtaaagagaactcacctttagaaatgatttcagatgtgggtcatttattattgtgaaataaatatgtctattgtgggtggatttttccatagggtaaatcaaagaaagaatcacctagctattacactagccttttagatttactgtagacatctgtgaaaaattatgaattggcctttattacaagactttgttttcaaacctttatttctgttccaatgtaaatgataatcgaactttactggagaaaagacccatgattttaaatatagttttatgtcagcttatagttttacatcagagtccatatagctgttagaaagttatgtgctactgacaaaataacagttggcaaaacataagacaaaatctacaattttattcacaggatctaactaatgtaccattattattaccaattgatctcagtgtgctataattttggtaacaatttctttgatatgcttttaaaaatatatatatatttacaaataaaggtataatttttaagagtcagtctaaacagactagattctagagggacagacatatattgacctacgacaatccctaattccggtgtttaggaatgtttgttagccatttttttcctctataagattacagctctcagaggatactaatattggcctatttgtttcctgacctcttgaggtaatttgaaaacacaggagaaatcgaggactatccctttttttattttgctccttctcaaatccacaagttatcaatttttaaatggaatattatgtttccaaatctttggtggggcttatcctgataaattttatttaaacggtgaactacactcctaacaaccagctttcttttttgttgcgatggagttttgctcttcctgcccagctgcccaggctggaatgcaatggcgcgatctgggctcactgcaacctgcaacctccacctcccatgttcaagtgattctcctgccctagcctctcgagtagctgggattacagggggatgccaacacacccggctaattttttgtatttttagtggagatggggtttcactatgttggccaggctggtctcgaactcctgacctcaggtgatccacccacctcggcctcccaaagtgctgggattacaggtgtgagccaccgtgcctggccaataaccagctttaactattgagtcaatactgtctaaatatttagagaaatggttaagcggcaggctcctgagtccatcaaacctggaactgtgtttaggcccaagcactctgtaactatgtgggcacatgattaacttctctaagctccagttcttcatctataaaatgggatgatattactcttctcatatgagattagaaaattaaataaaaatggtgtgtatcaaatgccagtcataaaatgaagtgcttagtgttagctttaatcataatcatctatttagtatagctatgagtgtttgattttgattttgtattagcacctctgacaatgtggatttggtacttaataattagcgggaaaggtaataatctcagtgtcggttacaattcgatttttcttcaaggtttttgtcctaaggagagagaggtcagaagcattcttaatatgaagctaagttggtgccagtttgaagtaacagctcatttgtggactttttatttttttttttaaatacaatttgctttgatttggtttggttcatgcatttttaaaaatcttcctcgtggtgttcggtcattagatttttatgcctaaagaactgaattcagttttaagtaaaattcatttaatattccaagtatgattccacgtggttattcattcacaacataaaatagccacataattcaatatatttgatagtgtctgctcatggaactgtggggaattccgcagatcttagacaagaattgcttaagttatagaaggcgatatccataatgctaattatctctgacatcatcgatatggcaaactatagtagaagaaaacagaagttgaacgtgggcctcattacacgtctctgtggaactctttggtggactcctgtatttaaaagacggcagtgatttaatgtatgcatgggggtgtccacaaaactgtgtatcttttcttgggaagatatatgtggaaaccatccttcacttttcaacaatagaaattgtttaaaaccatgtctcttcctctgcctttgccccatgggctgctactgctactgctcagcttcgttcagtgtaaatccttgattattctcaaaggatcccatctttgtctaatttggaaatacataattagttttgtattcagaaaaggtggaactagatatacatgtagaatactccagtacactccaatataaaattttgcctaacctgtatgtaatacttatatctaattagcattttaaatggaaattttaataaatgctatcaatcagtgaccaatttacatagcattcatctggggaaatgagcaggtcagaggatcagtcttcttgagattcatcttgacccaaacaatggtttaagatcttaaaacctttcattcttccattagtgtgcttatctttctgcattcgaacgttctagtccaagtccagatttgctaacttgtggttgtcaaaaatcaaggagtgcatttttgaagcatagacaagcccccaggtcctagcactttttttttttttttaagagacggagtctccctatattgctcaggttggtcttgaactcctgggctcaagcagtctgcctgcctccatctcccaaaatgctgggattagagacatgagacatgccgcccagcctcttggcaaattttaaccgtgtaatgttctgccaatttaattcttcaaagattccaattgaacaacatcatcttcatcctctgccctagttatatggtgtttatttgcagttacttcaggtgaccccccacccccctcagaagacacatgcattgcattgatttgtgaaatgatccttttcaaaacattaagacttaaggaagatatttgcttaagagcttagaagttttgcagtgcccaacaacatacctattgttctattttttgacccaatttactaaagagaaagaatttcaaaaccctgaaataacttcaaaatttatacagtgtcaaaggaatgtctaaattttaaataaccgccttgtgtttaaataatttctatgatatcttcatagtgtcccaattaaagggtgaatatattgatcattaacggaggaatagacaggctggttgtgacgttgtaatagagtgtgtttgtgagtcacgattttagagacccagagttagtgatagaaaaaaaaaaaaactaaggtgtggagactgcttaaaccctgagcggcgttagatatttccatgtatgaggatggatgtcttagacgtaatggaaaatgagaaagaaaagtatctacaaagaggtagaagagctgtattcatattcttgtagcattgggtataaaaagcgacaaaagtcaaggtaaagctagtatgttcaagaagataaggaaattactgttgttgttgaatcatgggaatgaggaaagcattttgtctttactggaggaaagaccgtgggggaagagagaaattctaattgcagtctgctaatcttactgataaatgaaaagagaacactgatccttcctttcttaaagtattaattttttggtttgggtctgtatttagaaggtagttaaaatatggaatgagagctgataaagatatgttgttgatactggtattgtgatgtaaggtgcttcatgttttccttgtttctttataaaaatgagaggtttggagggattggaagaaagcaccggtgaatctaaaaattcacgaacattcagtcattcaattctcagtttaatggaggaagaggctggaggggatggaatgttctggaagaaaaattaaaggaaggacgttggactggaagcaatgcaaaaataatgataatagtggatctggaggggaaaaaacacaattttttataaaaatttaagtgatgcaatgttgaagtatgttttatttaaaagtaaagctagttagaacaccacatgagctattccggatcagggctgtccagccctggtatatcatggagagtggctcgggccacttgcacacatgccttcagcccctggtaccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcctggggcgggctggcggagcgcggctcccggtgaggctccccgcgcggcagggtcgctcgctcgctccggggaccgcggcggtggcggtggcggtggtggcggcggcggcggcggcggctccgctcttctcccttgtggtgtcggaatgggaggaggctcggcgcgggtttgaatcggtgcggaggcaacattcgcatctgagatgaggtggctttttaacccctgagggaccacatttaaggatttcgaagagatggaggctgaactttctcgatgactcttcgtcacccggagtggtgcaggtagccgcggggagaatggagtcttttgttcccggtatttttaattagatggattttttttttatgagtagtgtactgtcctaatccgtgaggcaaagctgcccttttgcctgcattcggtgacttttacgaattcgttgggagctagtcttagcagtagtgattttggataatttatgtctgaaatgtgcaaaaatcggcattgagcttaaattaataagccctttggttccattaactaaaatccatcatactaattgcttaatgggggaaaaggtacaaaataagcttgctcattaaagagcagtcttttgcctgcgaaatacgtagtgtgatttttgtcaggtttaatagagcagtctctcagagaaattcaactttgcagttgtgcttcgatgcaggctactcctgtgcaaagatagttggagatggtttggaaaaacttgtgctgtatctgttgaagtaaaaatcatttgccattgatgtgtgtagttcaataaaacaaagatctgtggcagctgtgggaatgagaaagtcacatttcctccctctcctgtgctggcgtctctgtctctctggaatatcttataaatgatatatacagctatatgtgcctgtgtcacaaagtcattctgtcttctgaaagcctaatataatcaaattcagtgccttaagatggtgtagttgaagatttgatccccttccactaaagtggaaatactttcagtaattgaaagcagattcacgtctggagttgtacaagccaaggttttcatttttaaaataaaccttttgttctctggttttaaatgtttcagagagccatccaaagacctctgtgtgctaattgttaaagtagtacttaagaaaggattgcaaatacccagagaaggcatttaagaaatcagctaacttaactaagcctccctctcagccgaatattttagtgcagcatgtactggtctgtgccccacattgttttgtttttgttttttttttccagcggactcccaggtattaaaatgcgactgcagcgttcaaaacactctaggcagaggccatctgctataagaggttaaaaaacttgagaaatgttggtgttatcccattttatactgtgatttacacaatgtgatgatgaatttgagatccgctataaagtatgtttaatttaaagaggtggtgattatacattaactgagagactgaaactcacaaaaatatgaatgcaggtggttcacctggttcctttctctcatcttcagagactaagtgttaaaaagctttaaaaaattggctgtgaaagactgaaattagggtacattctagacaaagagggagtcacttgatctcttattagctgtgaagatagagaagaatagtgctgtataagagcgttaccttccttcttcaggacatgatatctaaaatgagttgtttaattatgaggaaaaagttaaaagagttgtacttttaacaatgacagttgacatcaggaaaagatagaaaggcgcattccaaatgtttttaatgactagtttcttaacctgttgtattgatcattaataagatgtgaatggacgtatttccagagtatgacatggcagtttgatttcttagaaactgctcggtagccctgcattttaccttgttttcttgccttctcagtagtttatcattgcagcacattatagtaaatatggccataattcaaatgatattcttgttattatgtaaaagccctcttttataaaaaaatatttaaagtattcagcagatttttaattaccaaataaaatcatactaaattttggctgttgcgtcacgtttcttagatagcagtggcctagtgtggggcataatagaatttaattcttctcgaagatttagaaaaagaaaagcgacttcacatggactcttctactgatgtctgaacactgattttcagtgtaatatccttgtctaaacatttaaactaaagctttttgtggcttctatttactgttagtttttatgttcctacatatttttacttggttaaaggggtgcacaggatcttctggcatctggaataatacattcaatttttcacgggactcctttctttcataacgtaggcaagtggcaaaggaggcactgtctaaatacagtgatcctgataattaatgctgtaaaatagattaaaatgctgtatttcaggtattcattcccttaaaagggccaccagaacagcgttgctaagcacccgtcactactgcaagtaacagaaaatgacccaaattaaagaacctgttctaagctgtattcttgcattttctaaagttcatttcaaaagatttaacaagactcattcaattagtggggaaaaaagatctgttttcagctctgatcagcaattaagagactgggctttggaacatcagttctttatgtttataatttatttcgtttggtaggctttactttaaacaattgtgaataaagatttttaacaagccacctttctagcaatccagatgtaaatgctaaatacaggacaatatatttgttttaaatttttattaaaatgagttattttatagtaactttgcctcatttaaagaaagtttaaatttcacactaatatgatatattaatgctttattatggatttcttactctgtgaaaatctatatgtatacatgcacacatacagacatatgtagtttagattaaaggatggctgtaattattctatcttatcatagatgtgagtgctttagcacctaacacttgagaaataggatgttcttccttaaggatatttgaatgttgtgggaaaatggtaccatgaaggagatagaatggtttggtgaagaaagtaaataaataaattattaggagcagaagttttctttttagattttttttttggcaggggacggggggcgggggggtgtccagtaaactgtacccttctgggttagaccagaacttctaagtagttgtggccaaatggttagatctttcagtggcctggttcttagctaacacaactgcagtcacaaatacaagctgcggaacttcctggcagagagaaaggaatgaaaggataagggctattagaggagtgggagagaggagcaggcgggttcccaaaggttcagattaggatcattagtgaaattttttgctggatcactttgatctagacaaatctaaagcatataaatatggattttaagttatgaatgataagtgctattttggctataatcacgtgaagtgattcatatccagaaacattgactgttttaaagcccaagtaacacacttctttattctaaagagatgttttgcattagaaatttattatgcttagatttatcaatttggtatgacagatagttctagcaatagataatgtgcaataaataaaagttgtataactcttgttggagttttgtctgagatgaaaagttattctaatactcatttttgcataaggccttttgacctgaattgagttctcttgttgggtatttggaataccttgtcttctgatatgtccgagtttggttttccctataaagaataacaatgtgtgtactatagagattatttttatatgtgtatatatatatatatatgcatacatatatagcaggtttgaaaggatggtattttcatatttaagaaaccagttgttttaggattgttgtttatacattgatttttgttacagacccagctcttcagttgaaatcctatgtatttaagttttgaaatgtctactcttaatttttactgttgaaagtaaaaattttactattggcagttgttttgcaggttgaaaaccactacctttttggtctcccagaaacagtttatgccacagatgttatgttggtacgatggtaaattcattttacaagggaggaataataattgaaaagtacacgcaaatatttgtgggcatgtcacatttaaataatagttaaatttgggaaacgacatactatagtatttaaaagaaaaacagagtttctctcttaaatgttatcattcccctcacttaatattaaatagtgtttgacataaatgtcttggtttgtacattgaggaggcagaatatattacaaaatgtaacaaaatgactaatatgggactaacataaaaaacactttagtcttttgtggttatatatattaacttaaaatttgtaaaaaattaaaacgatgtgtggaagtttcagtgagttgttttcatcctggtttgtgcacagtgcctttttttccttaaccttaaactgcagggagagatggggcctgctgtctagagacctgtaaaatgtaatctggatctctttttatgccttttcttttaaataaaacaaaattaccttatataacaagtttaacattgttaaccttttataattatctaaccattatttcattttacctcctgcttcaaagttgtaaccttttataattatttaaccattatttcattttaccttctgcttcaaagttgtacattagcggagtagacacctggctgagctcttaaaagtttatttggctttcaattcctgtgatagtagggggcagtacatctccttaattatctttgttcagggaaatgctgaaaggccagggtagttaaacaaggccatttggatttgtgaggtcgaagtcagatgcaaggaaagtggttaaatgcattatcatcttattgagcccatcatcagtaaagtgaccttgatggaggtggaaaaagccatttggctattttatgacagccacccctgcttgttttatcatttacacatttttacatatggctttatcatattctttcttttcgttttcaaatattatttcctctgattgtagatcgtcagaatgaaggtgaaaattaaaattagtttctttttaatgatagttagagtttctttcataagtgtgtttcatacatcgatttatatggaaataccccttcattaaaaatgaaggtgatcaggttagctaaccattctgtatttgcttttaagggtcttttaatgatgatgattagtctttttgcaaagaagctgcaattctgctacttttcaaactgtttttaagctagtaagaggaaagacttgccaacctcgattttagcagtgggaataatgtttgttttaacaagtgcctaagtatgtttacttgaaagttattcaagttttagtagttctattgctgccgttctggagtcatcacttccattacgaaattaaaacaaagtcataagatttatagtttatatttcttaactttatggccaagattttccttgtgatgtattttatatcaactccaataaaatggcattcttgcttatatgtttgaacaagtattgttcaataagaggaagagttttattaaacgcagtacaagagctaacgtttttggaaactccagttaaagcaattaagtgctgcatacaagatttttgttttcctaggcaaagctgtgaaacattactgattggagtttagcgtatgcttcactttatactgaattctcttttgttacaattaatgggagctgagtatgaatctttttatcatatgaaagaaaaaactggcccattaccaaaatacctaaaataatatttcatactttattggagatatctccttatcatcatgctatgaattatgtaacactaaaatctcagggactcaagatcatcaaaaatagttcgttcaggagagagtcacattttcttgatcagaaaggacttatttgtttaagaatcatttatttaaagaacaaattggatcaaaaggtgtttaaaatgaagtataaactctcattcccccactctgttcccaccatcagggcccaaattcaagctctcttcagttctccttagactaagctttccatttgggttgccctgccttctgcctgtcttttctttaatccagcctccacactgtcgtcacagttgtcattctgagttgtgttttatcagtcccttggtgaccatacctcaccctctactgctcctccactcccaccttcgcaccagtattttcgctggtcggtgctgcctgtgccccttccttgcatctcacagagtttccaagagctgacttgcatggtatttcttttttttttttttttttttttttttgagaccgagtctcactaggctgaccaggctggagtgcagtggcatgatctcgcctcactgcagcctccgcctcccgggttcaagcgattctcctgcctcagcctcccgagtagctgggattacaggcgtgcaccaacacacccagctaattttgtgtattttagtagagacagggtctcaccatgttggccaggctggtctcgaactcctgacctcaggtgatccacccgcctcagcctcccaaagtgctgggatgataggcatgagccaccgcacccggccttgcacagcatttcttgtggctcctcctcctctcgggcttccttagcacctgattcttatttctgtgagcacttaacacattatcctgtagtcatttgtttacatttctgtctcccccactagggggacaggttctttcagaaaaccactttgtctcattcgtccttacataccagcactaagcatgatgctaagaaaatagttattccataagtctcgaatgcttattggatgagtacactaaatataatttaattttgtggtgatggaaggtcattacaaacatcagttattttattgttctgtgtgaaaatataatggcttacataggagctgataaggctgagtatccctgtctaactggcctgtccgtgctgtcagctttcacttcttactactgctctgtcatcaaacaacacaggttattttgttgttgttattgtaatgtatgaatgaaataagaacagaaaggttctgagtaaagactcagagctaatttcattaacttcattagttttggcttctctgaagaccttttggcttaatgcctccatttctttgcattttctgttgggtgagattttggggtagctaagttccgataggtgttaggtgtttaggtgaagcaaaatgttaatttccacaatgaaaagaagttcattgaagcctaacagtaagtttgagtaagaaaaaaatgttaacttacatgtacagttaacttgaaatgtatatacattgataaagatactcatgattataattttttaaaaactggtaaacatcatatctaatgcaactctctttggatgactaaagtagggaagagataatctttaagatgataatttagaacaagaatcagtacaccttccgtgattgtgttaccagaagattaataggtgaggaatgttggaaggactgacaaatgttttgccgtcgagagatttacaggtgaggagtactagaagaagaggaaaagaaactccgtatttctgctctcttgctccatcttcatctaccttaagaacaaaaacagctgggcccggcatggtggctcatgcctgtaatcccagcacattgggaggccgaggcaagtggatcacctcaggtcaggagttcaagaccagcctggccaacatggagaaacctggtctttactaaaaatacgaacaaattagccgggcgtggtgacatgcgcctgtaatcccagctactcggaaggctgaggcaggagaatctcttgcacctgggaggcggaggttgcagtgagccgagattgtgccactgcactccaacctgggtgacagagcaagactctgtctctcaaaaaaaaaaaaaaaagaacaaaaaccccacaatactctaaaaaccaattttactttttcctgagaaaatgaatagaattagagacttttagaactgaagataatcttcaaaattatgtaatccagactggacattttctaagaagagaagccaaggcctaataatagctgacatttattatttactgaaagataagcatctgtgttaaacccattatatatgatttcatctcatcttcagaacaactcatgaaattaaatacttttatgatctctattttaaagatatggaaactaagtcatagaacagttaagttggttgttagtgagaggtttgaacccagacatgcaaatacctaaatcatgtatatctttttttttttttttttgaggatagaccttgtctcgatacctagactggagtgcattggcatgaacacggctcaccacagcctccaactcctaggcacaagtgatcctctcacctcagccttgccaatggttgggaccacaggtgtgtgccaccatgcccagctaattttttaaatattgttttgtagaaaaagggtcccaccatattgcctagactagtttcctagctccttggctcacgcagtcctcctgcctcggcctcctaagtgttggattacaggcgcgagccaccacatccggcctgtctttcttcattactgaattctgcatccagtgcagttgtcaaattaggttttgttttgattttagtcctaaattttgctttacatgtaagttctatttcctattctagaatagaaatatgataccagtctataacttttcataaacgttgtaaccattggatgttacaaacattctcatatttgctcaaggcaaatcatttaatttatcaagtgcttattgaggcaatatatgttttgtattgttctcctgtttttgtttttaattcagattttttaaatgaggtgtgatcatctatggtatagctaatgtccactctctgattaatatctagcaaggattagcatcattgatttgaaaattaatagattatgcttttattgacatttctattccccattgaatggcttgtttatttaattgatggctaatgtttttactattaaaggctattaacacatcagaatggtttttattgaacctggcaaaatgatagattatgtttgtgtttactcctttgtgcctaaggctaattattggtggtctttttatggttttggtcaactaaaaccttccggttaggaagttgagtaaattagcaaacttatctggtggtgtgaccttggaaaagtcgctggacttttctggattgctacctgtaaaaggagggaagtgaaccagatcaatgattttgaacagcgtagcttcttgtagaagttctgtagagtttcttcaattctctgattcagaattcttaaaaaaaaatcaaactaaagtggtaataaaacataatgtgaacaaataaaatagatactaaatgtttacatttgctactgggttagtttatttttccatacatgtcctgctttctttgtgtatgtatttgtactttttgtggtattttggtgaatgcagcttgcctaaggaataagaagtgacagcatcctctgcagagaaatcctaggaaaaaaggagtgtgcttactcaccagcttccagggaaatggttgtgctatggactgcatatgcctgccacttttggtatttggtcgtaatagagattctaaaaatgaagggggttgtccttattatgaatagattgttacttttccaatgttccgttatagtaccattcaccaaacttttttgaaactacttttttgaaattgcgtttatttccaagtcacagataaaaatagttcttgttattataggcattcctcattttgatgaaataccaatttaactagtttgattgcttgccttccttcacaggcttgactaaccagcatttcaaaaaaattagatctattcccgagagagtatttaccacagttaattatattcagaaaaaaataatgctaaaagcctgtgaggccttttcaaaagagaaatttctcagtattatattgagaaatgacttctgaaaaaggcaacaactcctgtgttgaccactttgaaagcaatagtattcatctcggtgaattctggagtttttaagagttgagtgacaatacattatagccctttcacgtgtcatgattaagggctgaaccagaatggtgtctttaatgggtagaacaattaaattttggaattcagaatctaaggctttatacattagttatttttaatgtgcaattgtttgttttaaacaagattcgtggccttttttaaactatgaaggtctgtgaatgtatgataatatgtttgatttctttaaagtatatttaaatttcatgcatattacatttcatacaaaggcaaagctcagtcttcacttctgtgcttccagttaggaataggagattcaaagtacaaagtctttcaaaaattgaaaaaaaaattatttgctttcatgctgagatatcagtataaacacccgatttattcaaatacttatttatctattaatattagtcattaatactgattaatacttgagtttttcaggagttgggcatcagaattgtaaacttaaagtatttgtctcacttcagttgaggcagaatgaatagaattaaatattcaagatttcaaaaatatatttattaaaaaagttgatagtatcttttcagttaaaaataacctccttgtgtattttttgtaaaattcatcgccagcccccatttccaggaatatctcaattagcaataaggggatgtctccttctaaatgcctgtggtgtactttaaattctaacgaggtaccttgttggaaggagaccacttgaaggttttattaacctctgcagtgtgaaagtgaaaacacgctgaaacgagacagctagttctacattctgataaaacaatagatcatcatcatgaccctaggacagaggacgtaaaaattgaataaagaaaggtacatttgaaacaatacattgaattatttatctatgtcttaagctcacatagaatataattctatgtatattagacttatctgtttaagacaatttattttatatgacttagccataatctgataacatgacaatgtcccagagcctgattcacatggtaccagaatatatgtccgtcacaaaaataaacctgcttctatcatgggggaaaacatttggggtggcaagctgaagtacacagtaaatgtactagagttctgtgagtgagaaaatatataccagctatacactagcggttgcctgtgaaaggatggaaagaaacaaaatgaaggagagacaagagaggggtgatagtggtgtttagctgtctctaaattttatttttttaaataaagcaggatatctaatgtaaacaacagtctgtgacattatttcatatgctatttaacacacaacagctacttctcataaatgtaagagcacaaacccatttatatatttcggtgatgttattaactagtattgcactttatttctttttaaaatgatgcttaacccagtaatcactgaattttagttgtacttagtcatgattagtgtaaaaatgtttttctataaaataagaattaatatgtaatatttaactgcagtctattttaggaacttactaatttcttaaggaaaattaattcataaatttaaaaagggaatttacgcagcatttgttgaaaacctactatttgctacctagtaagcgctttatcatcctattcataatcatataattttgagtccatttagactaatttctttccacttacatagtcaatccataatcaacagctactgactctaaaaaccagattttttggatctgtttattataatgcaatcacaatcataatttataatatcttcattcactttcctgccttaaacttttctctttaatccaaaaaagcaaattatcttgcttgggcatcacctgatcttctctctcccctgctcagaaagtcagtgtcatatcaagaagatgcttgagtctgattgaagtacaggtaggcttatggacaagtgacaggagaaggcttttcaggtggagaggcacatgagcaagttttaaaaggtggggtatgaaaagtatattggagaaaatatcaaatgacctacttcgagcatgaagttcacgaaagagaattttggaagataaggttagaaaagtgggttggaaccagaacatggaggaccatgaatttcagatcaaaaggtttaaatgtacctttgagatccctgggaatttagcatagaaaacaatcacacagtagtacggtgtgtttgggggaagatctctctggtagatgctgttagatgaattataaaagcaaggtagtattaatagaagtagagaaacccatttggactcttcctactattactttcaattcatgacttcttcttaaacttattaagaacagtttaccaaagtaaacttcacaaaggcaggggacttctgttcactctggtatcttcagagcctagaacagtgcctggcactggttgatgctcagcgggtacttgttgaattgaatgaatgagacccagaaagaccaagtgactgttttgaattcacacagctaagatagggacagatccaggcctaaaaattgcactcccagtttgctgttttcttgacatgctaggctgtcgtacaggtcattactattagcgtggctttttctttgtcaactcttgtcaactcttaccctaaattcttctgaactcttcttgcaagtgattgcaaactgcctcatatcttacatactcatcacagcctcctctgagctttttttttttttttccaaattgagacagggtctctgtcatccaggctgcagtacagtggtgcaatcatagcttactgtaacctttaacttccaggctgtaatgatcctcctgcctcagcctccagtctggcccacacattgccacacctggccaatttttaaattttcagtaaagactgagtctcgctacgttgcccaaggctggtctcaaactcctgggctcaaacaatcctcccacctcaacctcccaaagtgctgggattacaggcatgagccactgctcccggcctaggatcttaataggttgcttttatctacagacttaatgggttgaattgtttattgttacttttttcagatggtaaatcccaggtcagagactgtcttctgcttgttttatttttcagcagccctcctctctgaacagccgcactcagaacgcctttgagtgcagaagctggttgactgattgcccagcctccaagtctgtcttttagttcaagttcttatggcattacaaatatgtagttaaaactgtttttgtcagattggtaaaggaccacttaaatttacttgatatggccaggtggacggatcacctgaggtcaggagttggcgaccaggctggccaacatggtgaaaccctgactctactaaaaatacaaaaattagctgggtgtggtggtgggcgcctgtgatcccagctacttggaaggctgaggcaggagaatcactagaacctgggaggcagaggttgcagtgagctgagaccgcaccaccgcactccagcctgagtgacagggtgagactccatctcaaaaaaaaaaggaaaaatttacttgataattttgtaatactgatcactctgtataggcagggcattggttccaggactcccctcctcctacaccaaaatccatgtatactaaaggcctgcagtcatcctacacaacccacatctagtcagccctccccgtgtgcaggttctgcatcccataattttgatctgcgtttggttgaaacaatcctcgtgtacatggtcccagctggttcaagcctgtgttgttcaagggtcaaccgtagttgaaacaaatagaaaaatgaaaattttaatttttttaagctctctactgaaagtaatagtcttgtgagcctaaattatttatcattttgcaacttaaaagaaaaaaaaaactcggtgttactctgtttgattctgtgagatcaccttgaaataagataccacgtaatgagaactattgtgtgaaaccactacaaaaactgtgagatggccactgtcatttattgtgtagattttacctagtaagatcattagtcagtgtgttgctttatttcagtaggaaagtgcaatgggtgcaatactttagaccatgtagtatcactttttttttttttcttgagatggaatctcactctgtcgcccaggctggagtgcagtggtgcgatctctgctcactgcaaactccacctcccgagttcaagcgattcgaatcaagtagctgggattacaggcgcctgccactgcgcctggctaatttttttttttttttgagacagagttttgctcttgctgcccaggctggagtgcagtggcgcaatctcggctcaccgcaacctcggcctcctgggttcaagtgattctcctgcctcagccttccgagtagctgggattacaggcatgcgccaccatgcccagctaattttgtatttttagtaaatatggggtttctccatgttggtcaggctggtctcgaactccgacctcaggtgatccacccgcctcggcctcccaaggtgctgagattacaggtgtgagccaccgtgcccagccgtagtatcacttttgtgtgtattttgttataatttctttccctgaaaaaaaactattcattaaatgtaacagaggctcttattaagattaatacaatagtaaggaataaatgctcttaaatagaccaagaaattgctacacttttataaacatatataattgttcatgaatcattaacctttaaatttagagatgtttccctcacagttgaaaggagaaaagctaaaaatactgtattaatgatatagtgactttctctacaatatgaactattcagctatgagtcaaagaagtcgatattattataacttatcagatttaacattaaaaaattatacagtacttctttttttgagacagaatctcactctgtcacccaggctagagtgcagtggtgcaatcttggctcactgcaacctccgcctcccgggttcaagtgattctcctgactcagcctcccgagtagctgggattacagtcgcctgctgccatgtccagctaatttttgtatttttagtagagacagggtttcaccatgttggccagcctggtctccaactcctgacctcaggtgatccgcccatctctgcctcccaaagtgctgggattacaggcgtgagccaccacgccaggcctgttacaatacttttaatctcaaaatgaattaaaaatactagagtatgaactaggtttatattaaatatgacagtaatatgtagttctagaaggtatcgatttagtattttaaaggttatgaagttacaaaataaaaatttttaggcttttcatgctatggaaagagatgatatcagagaaatatgtttatgttttctgtgagataggttttgtgagagaaccatagttctgtattgtactggtttttacttataacctattaccttataaactgttgttttgtacataataaataagactaataaaatttttttgcttattcaattagaaggtttttaaatatgtcccttctcaccccctaatgatcagtattcccttcctgtgttcattcttttgatgtttactgctgaattaaccaggtttttgtctttaaaggttctttggcatattatagaaacaacttctgtgataatgtcattgaggtactttttgcagagtggggcaagggaagggtatgttgattaataactcttaggagagttgcataaaatattttctcaacctattgaagttagtttctagtaatgtctttcttaaggaaagagtttgagcacagtaaaataaatatttgcactgggtttatataaattactaagatcaaacattaaaatggtcagaatgcttgtgtcctcctaaaatttgtatgttgaaacctaatcctcactgggagggtatgaggagcttggaaccttgggaggtgattaggtcccgaggacttcaggaaggggactggtccatgatgaaaaaggaggctcctttgccccggctgctgtgtggagggagactcagggagcacacggctgtgtctgaatgaggaaacatgccttagtagacactgaatctcctggcaccttgaacgtggatttccagcccgttagaactgtgagataaaaatttctgttgtttgtaacccaccccgtttatggaattttttttatagcggccggatctaaaatatggggcaaataaataaatgattttaccaaagtcttagggaattagaatactccccccagctatttataaaaaaagtatactgctagagtcttcaattcaatttaataagtatttactgagtacctactatgtttctgacatcggtgctttattattaataatataagatacaggaaattcactactaaccatatacactgttgtaagaaagtaaaagcaacagtttttataatactgtaactcatataatttaataaatattgaccagttgcatataaaataaaatgtctttaaagtttttttagttttaacatttttattgagaatgttttcttctatttttttaatataagaggccaaagtacacccaagtctcatttctctattaagcttgactaaacatagataaacctgaactattattgaaggctgaaaccaaagtacgttatggtttattaggctgttaggctgatggattagtttaaacctcaatgtaaatcaccaaagaatacatgaagacaaaacaaaagcactgtatgggtgcaagaaagatgtaattcttcattcactgggtttttatgcatttaagggtatgattgttccctagggctcccataatgaattgctcagtctgagtggcttaaaacaacagaattgtagtctctcacagttttagaggctagacatccaaaatcaaggtgttgacacagccatgcttcctctgaatactctagggaagaatcctcccctgctttttccaacttctggttgcccagacattctttggcttgtacctgcatcattttacctccattttcatgtggacttctttcttctgtgtctctgtgaggctcaggtgatcctcccacctcagcctcccaggtagctgggactgcaggtgtgtgccaccatgcctggctaattttttttatattttttgtggaggtggggtctccctatattgctgaggctggtcttgactcctgggctcaagcgatcctcctgccttggcctcccaaagtgctgggattacaggtgtgagccagtttccagcctctgcgtgtccatttatcttataagaaccctgtctttggatttagagctgctctaatccagaatgacctcatcttaaccaattatacgccaaggaccatatttccaaataaggtcacattccgagcttcttggtggccatgaattttgagggcacgctttccaacttactacagaggaaaaggatacaagaaggtaaaaaaatgcttctctttgctgtcttcagttttttttttttttcctttcccattccttagggggtttagatacgttagaattgagcattcttgccttcacactcctattctttaaagatattttatctgccaaaactgacttatgtttcttttctcccaagagtctcacattatgggaagtgctagtaagccagccatagaattttgaatgtttgctattcaatcataggggaaattaaaatttagtttttatgctttttttatttcagaattttaaaaactagaaacaaaaattctggagactgccatactctagttgtggcactcaaaatgtagttataaaccttctggtggtaaattaagcatcttagagtatcctagtcattagttataataaactttatgtgagtatggtctgttgcctcaatttctctttaaggtttaaacttacaaactttttaatgtaaaagagaaatgatataagtgaactttatgattgtcaacaaagctgatttgtaatttattttgaaaattatctttggctttcagttttaagtggcaaaactgataccataaataccaaaactgatatccataaatatacataaagcatattttgataaacacatgacgtatttatctgtaagaatgaagggatatctaggccaggaatttcaagaggtttgtcatcatttttcaagacaataaatgatatcctgggatctaaagtgttatgttcccgaggaatgatgcatgagatccttttctgagagcagctattggttaattagatatgggaaagccctttcagagaagtggacttaaggaggccacagagaagagaagagcctcaggcacacactgtgtctggcctacaactccactttgggtcacccctgccagtaggagagtctatatatgaactataatgacatggaatatagtttaaacccatctttatgaacacgcaccctgtaaagatccaatctggtaattagagtgttagagtggtttatgcctttttaggggagcaggatagaggtggaggatgggaaggggttctaaatcagggacttcaatctgatattttgtagtgtttgtaaatgggtgtcatctactgagattcctcattcaggcataagagaatgtcctcctttcctcaggttgcacaggaagaggagaaagaatgggtgatgatcttacctatgaaacttaaattcataataatatgaataggcattacatttatgaaaaccttttgccagtttaaaaatgttttaggccgggcctggtggctcatgcctgtaatcccagcacttggggagtctgaggtgggaggatcgcttgagcccaggagtttgagaccaacctgggtaatgtaggggagactgtctctacaaaaaaatgcaaactattaaaaaggcattacataacaaaagttactttgttaacttgtttttatacaaaattaggatgctccgtatatttgacagtggtcagatttccgctgtgggtggggctgtgtggtttaagctcaaggtaaggtatatatgctgtgctggatgccagaagacatgagtcctgatctgtgctcagctaccaactacatgacttgggctggataacaaaaccctaacagacgcctcaaagaccttcaaaagcaatggtttggattttttttagttctgaaattcttccgttatccttttatttaaactaacacataacatctgcatttcaggtgtctgttagtattgatcagaattgtattgtttgtctactactacctggaaatgttcctgatgatgaaaataaaacattcccttgttatgatctgcttttttggttctgttgatttgtttagcagaatagcagcttggcatcatactacttttaggagactttccttcaatactatgttaggctctgtacccataagttctttcattatttttcaggagtcttcaagtaaattgaaaataaaaaaaatcctgtgtgcttgtgtgtgtgtgtgtgtgtgtgtgtgtgtgtgtgtgtgtgtgtgtgtatgtgcatgttgattaggctattaacatcgtgtcttcttttttccaatactaataatcactaatttatctatattttgaactattggccagttactctgagttaaagaaaaaattaatctctatatggatttaaaacaaagatcagtaaatcaatgacgatgagatgattttaggatcttttttacttagccagaagggtcatcaactgatttttgaaagttatgtttgtttgtgcatctccaatggaaacattatttgtgattagtttatttttattcttaagtattcttgataagcatctgaatgtctgcctgaatgaatttgaaaaactaaaacaagctgagatttaatgtctctgttttagtgttagtctctgctatcatatgccccaatttcataattttattgtaataaaattaaagcattaattgctgcatttttagttcacgtaattcatatttcatatattaaagttcagaagagttatttgtaactctagatagagaaggacttaaccaagatcttgaggaaatgaagacccaaagaagtgaagagatttaggccaagcacggtggctcatgcttgcagtcccaacactttgggaggctgaggcaggcatatcacttgaggtcaggagttcaagaccagcctggccaacatggcgaaaccctgtctcaactaaaaatgcaaaatgagccgggcatggtggcgctcacctgtagtcccaggtactcaggaggctgaggcaagagaattgcttgaacctgggaggcggaggttgcagtgagcagagatcatgccactgcactccagcttgggcaacagagcgagactctgtctcaaaaaaaaaaaaaaaagagaactggaagccagctttctggatgcttaaccagtattctctccattataccaatagtttgttaaaataatggcatttgctttagagaaattcaagtagctttctggtctgtgtgatatctatgtaaaatcctgttttataacataaatgtaaacagtgattttaatgatatttttttctgttgtctcagatatcccaggacatctggaagagttcctataaattttagttttttaattacaaaatatccagcggggacagggccattttagaaatgagtaatgaaatcatagagttagaaagaatcccaagtgaccgtgaatgctaacttgtcccttgggtaaggtcatcatttaaaaaagtacgaaaccattttatatgctgtagaaactggcttcgtaatgggcccctaaagtcatttatctgtttgtactgtcctaagcaagtcatttattaactagtgaaaataatatgtaagtgttctgttgtaaatgtgatgatcaaaaactatagtaaacagagaaaggcaacccctaatttatgtaaacctgtattttagaagtttgtttataattcagaaagtattttctcacaatatcttagtttcccagggtaatccatacattctatttaaccccgtttaacatatgaatgataagaaggaccatcccgaaattcttgttctcaattctagttctgaatgccaagaacacagctcctttggttaagcatctggacttcaacctgaccacttgcactagaccatagaataggatgtatgtagaatttcaaaatgaggaaaggagagggaaaaacatacattaatggctgctaagagaagagaaaagggtcatatccttggttactctttgccaaaaataaaaataaaacacattgtaaggaccaccatgcttttgagctcctgtagacaccaggcaaggatttgccataggacatttgtgtcagttagggtgtatccattatgtagaaagctctaaaacttcaccatgggaatgtgggaatgggtctgttctgagaccttttcaatgttgtaagtcattagagaactagcctcaaaccaaaactctccatgattcccaggtaaattgcaacacatttagttgcatagctctgaaacttttccatttgaatacaacaattaccgggtgttcaggaaattagatttgttgcaatattttaagtgatttaaatgaagatcagtattattttttagtatagaaatcttctagtaacagagtttaccacgtccgtcaatgtgaatacaattatatttgcctcgaattttatttgcatttgtttttctgcctattttcttgtggaaattttaatgagcagtgaaatgaccaaaagctgggccacggagaggaaaataaagataatctaaaacatgtttaattatcctcagcataatacacacttcactgtaatagggataatgcaagaacattcagattatctaaacacatttaaaaatggccttccagtgttaggagcataagtatgccactatgaattgtgtgtgtatgatgaactttcttacacagtcatgtgttgcctaaagacatggatgcagtctaagaaaatctcattgttaggtgatgtcattgtagtgctacgatcactgagtgtacttacacaaaccaagatggtatagcctactgcatacttaggctgtatggtatagcctgttactcctaggctgcaaacctgtacagcagagtactctactgaataccttaggcagttgtagcacaatggtatgtattggtgtatctaagcagaaaagatacagtaaaaatataatattacaatcttatgagaccagcatcatcatatatgtggttcatcattgaaatgttatgtggcacatgcctctgtgtgtgtgtgtgtgtgtgtgtgtaagtatatgtttataacatgtataaatgcttttacttataaagtaattatattataaaataaacatgtcatgaaatagtgtacttaagaaataatccgaggtgaatagattatttaagcactattccttaggatagcacagtacatcatatgtcttattcacctgttttcttaaaaattgtattcagaagtcaacttttattttaaaacctcattaaatcatccttataagcaaaggtaattaagatggtgtcatttcattttagtgagttatagttctctggactctccctctgtcactgtttccaattagaatttctctaaaagttacaagagtagttaattttaattactaaaaatacctagggggaaatttgttgagtggactcttgaatttcaagggatttttgtcttgcaagtaaattatagagcagaggctataaattagttctccattctttttagaccttgaactttttattattctgcctaaatgtaactgtaacttccattttctcatcttaaaatttgcaaatttatgttctctatatttctttcatgattagcaagaggtctctgtcttacatattttttgaaccttactttctcaatttactaatttgtaatttctactctaatctttattaatccccttctttttcttagacataattatggctattaatatgctgctaaatgcaactttgtccccattccatgtgtaggtgttctttttaaaattgttctgtgtacattttgtgattgaatatttgattttctagacattttgatttttactatttaaaactttctaggtttaattcattgataacagaaaatgtggcttggatatgtaagctttttaaagatttgtaagggttttctttgcctcttacatagtgatcttcaaactttttgcttacatactcactaaaagaatttgatgaactcaataccctcctacacattttaaagttgaagtcaaatacttttcatcacaagtaaaaataattgcaaaggattaatttccagtgtatgacaaatattgatattttaaataaattgttatatcacaatttttttttaagagagtctcgttctgttgctaggctggagtgcaatggcatgatcatagctcattacagctttgacctcctgggatcaagctatcctctcacctcagcctcccaagtagctaggactaaaggtgcatgccatcatgcccggttaattgtatcattttgttgttgttgtggagacagagtcttgctatgttgttcaggctggtctggaactgctggcctctattatatcatgactattcagtgtccattgataattataaacaaatactatatgctcttccaatcggatgctcaccatcaggtatttattaataatttacgaaactcctcaacactagaatattttacattatttcttctctttgaaatttgtattttcattccacatttcctggaatattttaatataatatacctttattcttgaaattcctttattgttcaacttactgtacccttctgcaacaaatgcagccatatatatatttggaaaatgtctatggcttcaaggtcctaagagatagaaacaaagatcttctttgaatttcagaaacaaatgctcttctttgagttccaaatactgttataatctgtacacacttgatccaaaaccaaacatgtacgctctaataaaaaattattgtttataaaaactggccgggtgccgtggctcatgcctgtaatcccagcactttgggaggccaaggcgggtggatcacgaagtcaggagatcgagaccatgctggctaacacagtgaaaccccgtctctactaaaaatacaaaaaattagccaggcgtggtggcgggtgcctgtagtcccagctactcgggaggctgaggcaagtgaatggcgtgaactagggaggcggagcttgcagtgagccgagatcgcgccgctgcactccagcctgggcgacagagcgagacttcatctaaaaaaaaataaaataaaataaaaaatttgtggccaggcactgtggctccgcaattttggaggccgaggtgggaggattgcttaaggccaggggtttgggcaacatatgagaccctgtctctacaaaaaataagaatattagcaaggtatgttggcaccacctgtagtcccagctactctggaggctgaggctggaggatagcttgaactcaggagttcaaggttgcagtgagctatgattgtgccactgcactccagcctgggccacaaagtgagaccctgtctccaaaaataattttaaatataaataaataaaattgtattggaaatgtatctcctgatgagatgaggtggtaattataattgttcgtggctctttgatttgctgctctagaatgggcattgcctcatggtaagtttctaggtagatgagaaaagaagctcttctgtaggtaccagatcagccaagtcaatataagggcctgaaatgaattcctttgcaactgttcaggcttacctaccccttagaaattttttactcacaggattatagataccatggcttgaagaccactggtctaatagatggtacatttttatgtatgatcatattatgattattaatgcacttgaaaatattcttatttgtaggcatcagcatttgctctctatgcattcaaccatatttaaatgtatgatttagatgagtgagtgtaattcagctagggcactatttagcattgtggatgggataattcctctttttgagaaactgtctcttatattttagggacatcacttagtctaagtatccttagaggctaacagacattgtggcaactcaaaaacttcacaccccgtttccagacattctcaggcaatgagaactgtcccagattgaaaattaccgacataaatcccaaacatcctttttaagcctgtttgcttctttagaggtttaaaagacctgttaaactgttttgtttctgttctttgtgtgcatatttcttactgttttgctttattgacacatagagttcatgcctattatattttcattgtaggctgtaaccttaatatatatccttttttatctaagtgaatgctttcttctatcataattctattttatttgatattaatattgtatccccttctttttaattgaacttacctggtttatgtgtgcctctagctttgcatttaaccttcccattatcgctgctccctaatgctgttgtcctcttgtgcataatggttgcaagtcacattgtcccatctctctgagacctactcgtatctacacacttcagctcttcaaaagagttgatgttagtcatgcttcattaaaatttcccccatataagtcctctgaactgcaagggcttctgaagatgggcagtgcacacttattggaggtaccttccttccactagtcacaactgctgtggatccagcagaaattcctcactatttctggaataggaggactcctttagtggtaggttaccccctggtttggtatctttaagtcgtttcatttcatattagaacggaagactgttagatgcctatgcctaagttgccgtcttatttgaaagttggttattttttaaaaaattattctttttaaaatatatcagtgattatcaaattatgtaaatacaaaactggtcgtggaatggagaatgggtgtgtctactattggtgtatattacttatttaaaactgatcaatttttttttttctgggtcagttttgtgaaagtgtaacttactcaacagaatgacttgatggaagttgtagtgaacaaatcatatcattgatgacgggggtgtgtttttatatgcctaataatgttagactgaaatgccataatactagaggaaatttagaaagcattttgtagctcttaaaagattgatactttggtagcttgcattattagaaaccagaacatctatctgcatacatatacatacttctttattcagttcataaatttaacttgtgaaaatgacaagtagtagcaagctcacactcgggatttaatcttcactgactaattcatcagacattttacctttctgtagtcacagatggttttaatgtctgtctgtattgaacaatcactcagatgtgtccatcttcgtctttattggataaataataattcagtatccctcaagtgactatgataattggattccagaagagaattcaaggcttctaggtactatcatattcaaaatttgatctctgtgttccagtctctctcgtacatttgaatattttccagcttaagtggaatatatgggacagtagtattttgtgtaaattacttagaatagattttgtagagaagccctaagtgtaacctctttgctttttaaaaatggcatttgccattccaaagtaagtccctggtggtgttacttgactcattccaaaatgacctacacttgattaagtgaagtctcatctaatagctgaaactccccagagatttttagtggctgtttaaaatgaatgtctgtatttaaacccattttagtctatagccaacctttatttcctctatatccagaggcagaaaacagatgtatttcttttttcatctcttgttggtaaaaacagatagatgttgtggcagtggttatgtgtatgacttttaattgtttgggtttggagagaagaaaaacctgatagcatattaaagtatttaagacaggcttgatgatttctgtgatgctggagaaatgtatatttttattgtcaatgttttgaagagttagaaaatgtttatttttaaagaatggtactaagagcataaaatttcagcagtccattctatgttttcaagatttatgtatattatatatagaaacatacatgtgtgtatatgtatctatatatttggacacacatatatttcatttctcaagtttttattgctgtaattctctgaatttactcatgctttccttaggagcctctatatcaactgcagaagtgaacttttaggtctgacagtgagctgaacaatacttccacggataaagtacatggtcttgaagatcagctgctgtaaatgttataagaacttattatcgatgggagaagctgaagaataccatctctcctgttgtctcacaggaggtcattactgacattggttttgacatacttgaatcttcagaaaggttattattgtccacttcttaaagtttagtctgaacaggcttgttctacttctaaacccaattgaaatgagtctgtgttcaacactgtttataaggttctccatgccagaggacagccgctatctatagcagaatgaagatgaggcagaactatttccgtgagatatttttacttcaaatatttatttcaaggattgtgccacagttagtattttaatttgtttttagtagtgaccttggctgctgtgtatattggtacagtgtgctagaggcagcacttttcactgtccattttcttcaaaatctacgatttgatcaaaaccttcaagcactttacagtctagaacctttgaaatgactagagagttgtatagggattgttaccttgggtagaaagagccttgtatgagcatcctgggtgactgttttctgagttttacccggaaggaagtgtgaagacactgtcttccgtcttttgccgtcatcagcgttccaccttcattgagaccctgcaagaccctggcagccttggcttccaggcatggtttacaccatgtgaaagcaaacaagtaaacacaaatatcaagcctaaatttattttttatggtcacagagttcctaaaggttaaaaactttcagaatgggtctgcatagggccctcccaccggcctcctgaatccctcctccagtgactttcctgtcaggtttataatgtcttttcgttctttatttcttgattgcattctatgattttcccctaagacaagctgtatgattaaattacccaagtttccaggattatacttttctttacatagcacaagctgtttaatacattttgtatctgagatgcaacaaatcacatctgagatacacagataaacagcagttcatctactttattttttaatacttatttttaataatcaaataaaatcatactttatgtctttaaatcatatttttaattacagaaagtgaatattgaaaaacaaagtaaaaaataatgaataaaattatgcagatgctctggaaaatacctggagagaacctgtgactaatttggtacaaagcagaacaaatgttaatttagttatagattatatatacttttatatcataccaattgtcaattttacacatagtgagaactgtttcaactgtaaaatgtctttcaggaacaaatctgaatattaatttagcttacttgtttctgtggaacttaaacacttttgcacttttctttagaattttgaattttaaaaaattaaaaataacttttgtaattgaggtaataatcctcatttgtagtgttgaaaatattattttcatactactctcattctttaaaaataaacactaaaaataaccagtccagtaaaattaaagaattagtcaaattttttctaatgtcatgtgaaaatttattgactattttattttttgaaatattagtgccattgtagtgccagttaaaatatttaatggttgatgtacggtactttgctaatattcattctgcttatgtcattcttataatatttttaggaaaaaaatttgagtttcatatgtagagttttttttttaataattaatctcctgtaaagaagtgtgccatatggtgtaaaattttgctgtactatttttcaagatttttttgtagccctcaccgtgagtcttcccaatcacaggctttcatccttatacagtgacttgactctttgccactagagggcagtaaaaaaatttatatgttaataaatataccattgtagcatttttttaggcttttgtactattgttctagaatatcaaccctggaaagtttatctagatgtctgctcttcaaccagaaaggaaatacacaaacctgggtaaatttatcttcaaatctttatggattatacttaaattttgtgttggttatattaaaactagttatgatattatagataaaatattatttaatcatgcagagtttctagaaatgtatggttttaaagtactccttttgttttattagggtggggattattttaggaatggaagacttttatgattgatggttgttggctaaattttattggatagattcttatttggtacattttatttactagtatattttacttgaaggaatgtttgtcttttaaaatgtttttcaattttttgaaaattgtagttggaaactaaaagattcagtacgtaaaatactttggacccaatacttgtcataattttccttaacaatatagttaagtgttcagtttagtttcctgttagacacaaaatacagtcttttagcttggcaagttaaaagtctgtaattttcagaagtgggtagaattactgagggatagaaatgttaaaattttctaatgatactatacatgtttataatttatttagttctgtgatgaaataccaaagaccacttttatggattagtcaggctacgtttttatattaacttacctttttatttattttattttaatataaataaattcatgaatttgacgattataaatatatttattatagtcagcccatcatccccagaacactgcagcctaaactcaggcttatgagtacttaattactaaattggaaagtgtagcatcttgttaaaacagcaaggcttatgatatcgaatgtgtaattttgaagaaatgaggaatgccatttgtttttattaagctgggatttgagtgtttgaagaaagcattgagggaggcatttctttagaaactgaagtaataatcctcatttgtagtgttgaaaatactatttttacagtactctgactctttataaataaccataggatctactgataaattgttttttgtcattttccattctatggagaattctacgtaacttcaaaattagaagtaaatatttttgatctcttaatggagtataattttcttgtgagggaaaacccaatatatattgatttaggatttctgagatataagaaccttttttatgatattgatattctgtaaaaacaaataaacggatggaattataaagtctttttccctgaagtgttgcctgcacgtttagaaaataaatgtatttagaaaagacaaaagtaaagaatagttattttttttcacataatctattaatatattgtattcttccttgggtatgatggatagcaacaggaagtatttgattatagtttcaaaaattgtatcaacagtattctgttttgagaattacgatctatattattgtagaattttaaaagtggttttccagatatcacatttttaatctctctgagctgtgtggaagattcacttattttggtcatgctaagcttccttagtgaaattggcactaaaaataaaaccaataataataatttaacaagtaaaatcttgagtggagtctagaattttacagtaatttagcaagatatcttaagtttcactctcccagtctttcaaactgaagccttttgcaaatatagctgctggaggctcttggtatcgttaattgtttgctaaaatatcctagaaacacagcaggccagttttctaatgatgtttttcaaaatcacaatttccttttgccaaagtgtgaaagaattgtttttgaaatacagtttttaagtttgcttgtaggccttaagtaactaatatattaacacatttgctttaaattcatatatatgcatatatatttaattttaaaaagtgtcttcgtaaagatgaaaagttaaaatttggttctaattctatttggaactctgtatctttgaaaacagtactatttaatgaacaattggttgtatcattttaatttttcttttttttgaaaaatcaaagcatatagatattttatgaaattttcttaggcttcttgtattttaactctgaatttatgtggtggatctctagacacaatatgaattttctgtcaatgactaaaatatggttttattatgtcaaatctgaactgacatatttttaggcaattgtttcagggaacagagaattgggtatttgattttgagatatacggagtcattttattgagtttgaaaggcacaagtagttgagagagtttcctttttttctgttaaatactagtctatttgaagagtcgttttcttttctttctttctttcttttttaatataatcctcttatctattgcttggggttagaagttgagaaattgcattttgccaaagtgaataattgagaatttgtaacacagactctgaaaaataattcagagagaggccaagagagtttctataacaagtcgtaaatatattttttaaagaaacagactgaaaaactaatttctaaatcaagatttaaatgtaacaataaacaaggagttaaagagaaagtccagatataaacctaaaagttaaatcgcttttctttatcttgaactttgtgacaataaagaagacacctcattttctcttttactttaccttgacttttctgaaattcttatgaaataagtatagctcctgttagttatctgttttaaacaatcttttgtgcttaaagattcattattcagtagggtaaatcctcacctttacacttacgttgagatttttttaaaattatttttctactttaaaatatgattataggccgggcacggtggctcacacctgtaatcccagcactttgggaggccgaagcagacggattgcctgagctcaggcgttcacgaccggcctgagcaacacggtgaaaccccgtctctactaaaatacacaaaattagccaggcatggctgtgtgcacctgtagtcccagctactgggaaggctgaggcaggagaattgtttgagcccaggaggcaagggtttcagtgagccgagatggtgccactgcactgcagcctgggcaacagagtgagactcttgtctcaaaaatcaatcactcactcaatacaataaaatacaatacaattataatttacttctaacaataacttaatgattttttgctttatatcaaaatttaagaagtgatattttctttgttactttctttcatttctggttattgtaatggaaggcaaaatatgacataccaaagaagtaaatttctctagacagtgcacaacactgaagtaaatgcagatactgtatcttaattgagtatatttaaatgcaatgttaattaaacttatacttcagtttttacctatgaacctaaaacaaaagccaccaattatacattgaattttattaaatattgtatctataacttataaaaataatgtaaattcagtgattttcattgagacatgctgacctagaatcactcactgaaaaataggttttgaagggtaactcttattttactataaatacgtttggcttaattacaataatgcttttcaatttatggttccttttctttcaaaataaggataaagtaaacctagttattaatatgcttatatctatattgtagattttttgtatgttcctatgaacataatacatacattgattttatttgccttttaataacatgggcagaatgtaatgtggaaggtaccaccactaattgtgattttaaaaaaattacccttcagtgtaatcctgcaactattattgtggaatatatcaatatgattaaattttggcattgcagaacagaatcttcactgcactgtaggttagaatacaagaaaaattgaaaataaaatgagaaaatttctttcttaaccttttgcaattttagtataattttgctaacctgtgaaaatgtctacacataggcattgtcttgtacatggcaagacagcattgtctctgacacacctgcattatttgagatgtatgcattcatgtcagttcttttcagaaacagtaggtaggtattacacaggaatatggtctatttttatggccttctcccataagatgccttctttgtaacatatcacagtgtacttaaaagaggtcattaaaattaaaaagatccaaggaagcagttacgagtgtagaccttcaatatatgaattaattttggatttcagattccttttagatttgttttagctctctacatgtcatatacttaaagttttcattgaaattaagaatattacccaaattttcatattgctttaggaatatttacaggaaaagaaaaagaacatgtttgttcttcagctatttttttctttacggagcatatcatcaccacaatttcatattcaagctttaaagcagaactcattaatgcatgtttcatatgcgttgccaaaaatacaaaattgttttcttgctttatctagtgctgagatttttagctggactaacaacattgtgtttgtctctatggcacattatcaacgtgtctctgtagcagaaatagtagatggttggaataaatagtagacgtgcactggtgtgtgtttatgtttatgtaacagtaccattttccagagctatcatttaataccagcactttatgccatattgaaggacagttgcaagccaatgacttgatgctagtttgtagtcacatagttaatgtaagagcctaaaggatcaagcaactcagcttctcaaatattagggtcatttgataccagttctcctagatgtgatttaaccattgtttctagaaattagaaatggaactactatactaataacaaaaggagcaatgtgtgatcccatatatctcaacaatgaggtatgtctaggaaggtatagcaatataacaagattgtcagtatatccattagtatgtctgtgtattagtctgttctcacattgctataaaaaaactacctgatactggtagtttttctttataaagaaaaggggtttcattggctcacagttccacaggctgtacaggaagtatggctggggaggcctcaagagacttagaatcatggtaggaggcaaagaggaatgaggcatgtcttacatagccagagcaggaggaagagagtgaagggagaagtgctacccattcttaaccagatctcgcgagaactcactcactatcacaagaacgacaaggaagtcctcccccatgagccagtcacctcccactaggcttctcctccagcactcagggttacaattctgcatgagatctgtgtggggacacaaacccgaaccacatcggcctgttactttcatgagagcgggactcatgctttcttactatcaagttatttctagcatttatgacaatgactagacacccacacagtagcaaataagtgatgatagcagcaaacatcaagtgccaggtactgttctaagtactctgcatagatgagtgtatttaatccttacaccaatccgataaaataggtactatttttaccacccattttacaagaaatgaggtgaaaaagagatgaagtaactggcctgaggtcatgcagctagtcagttgtggagctaggatttgaacccaggcagtgtggcttaacacttaatgctccgaatcattaccatacttctcatgtgtatagagtgcactattaccaatcaattttataggctctgtttccttgttttccctttcacagctgacagaacagtggtaatactttaccttatttgttccatgtggttatttttaatacatggggaaaacgagaaagttttagaagttggttgatatgaattaccctttgaatacgattaattttgaatgattgtgtgcctacctatgagaattgtttgttaaaattttgtatgtcaggaaagattcaggaatattaatattaaataaattaatgataaagaaaagctgtcgtgttatttctgaactggagtacccatttcaaaatgtattaaaagttatgcaaattggtccttcttagagttactgataattgtgtgatttactgttaatgatcatgaaagctacttgagttgatactatgtctgaattaatttatttatggaattataagacaaaattaacttgttaaaaaattcagtacagtagataatgcaaatattatcatttaatatacactactaaattaatagttctctaatggccacagatactccgtgttttaagccatgttagacattttatgatgtttcattttaacttagaaagatacatagtacctttattataaatctgtttttcatagtttattaataattcaaaaactttcaagaagacattttatcttatacctcctataaataaaggtataccatgttccttgcaggcactgaaaaattgtggtatggtatataaatcagtattttctggtaatggatgtgcaaatggctttcacagccctgtcctcgtttgtatttttaggagtgacataagtgtatatataacattttccccttcattacaaatgcatcagcaaaactgctgatactggagttgtaagagtattaactggttaattttaaaagagtgacagagatccctttgtctaatggcaactttatggaaatgaacatttcagatgacttcacaaatttttttttcagactccaaaacaaaggatattatatatcaatttatcatcctcatccagtaacatgcaattatacccaatttcaatcctgaccaagcaatcaataaatttaaccaagtaactataaatacatttgtctcacatactgtatgtgacacatatatgcatacatacagtatgtttataaatacatactggagtctcactaaatttttcaatatttgatactttgctttagaggtaaatagtgaacatagaagcaaaaaagtgtgatggagtttgatatgatttatctgtgggtttctggaatttggtattttaaactaaaatctgaaaaaccagtatttcggtaatattttattgagcaaatgctggtgttaggtgtaccatgtgagctgttgggatccaatgctgagaaagacagcatccctgttctcaaggtgtttatagtcgattcagaaatgcagtcaaggaaacaggagattgtagagtatgacactggttttatacagttttatgtacaggattcaatggtagcacagaagatgggcagctaacccaccttaggggattctatagagacctactggaggaaatcacgtttaagctgatacctgagcaatgaagagaaggaaagctgagctagggacatatgtggtgtcggttttgcagagtaggtagcatgtccaaagctggagccggaagacagtgtcagggagctgcacatagattaaaaccatcagagtgcaggtgtggaagaataaccataaagatggaaaccaaactgagatatttggactttatctggaagtagatggaaagccactggaagatttttaagcatccaggcttttaaaaacccttttaaataaacttttaaaaagatttaaaaaagaaaaaggttctactttgttacctttcattcttaagaagtattttaattgtgtgtgggggggagggtgggtgggtggtcatccctatgggaaatatgagctactataataaataaactttaaaatatagggaaacaaggaactatattaactggctggatggccacatcccagagacacctcctttgtaggaatggggagcatgattttattaacagtttatagctgccaatcactgacacaactagttacctaaaatagtcaatgctgttctcatataatgaacagttacttgcaaaaagaattaagctgatcaaagtaaatcaacaaaaatcttggtaatagaaattttatgtaaggtccaggatcacaaaagccacagaaaaatgcagagctagaacccccatatgctgcacttttattgcaggagagcctgaagagtttccatctggactgtgtcttaccttctcagacaagggcatgagggtgatccagttgtggtccagattgtcttattgtaaagggctaagcttaatatagataaccctcaatatacactgccttggccttaaggaaactgaaatttctaaaatggttttaagatgagtctagtcccttgggggtcttccagatgatgttagttatctaagctagaaagacatccagttcctggcaaaagaaacggaacaaagcattgtattacatgacgagaccccctgttttctcttttctcttcctctatgtgagtcatctagtaccacatctcactcggtatcataactttgttctgaatgtcagcagtgttaaaggagctccacagcggacatttcctttaacccgctaattcttgcacgtggtttctagaatttggtgagtcaccagagtgtgggatacaatgtggaagagaaacagccatagctagccctttttatgactgctgcaaactagtgttgtaatatagttttatgttcctcttatctgataccaaagttacctgtatggaaagcccgggatgaagtgtgaaactggtgattattatggttactattattttgtgtacttgtctctttatcgttgaattactatagataacagattaactgtatttaactatcgcatatcaaggttgtgtagattacaaattaaaatttttgaaaaagaataatagagtaatttcattttcataatgcaaaataatgtgcatttggttagggcggtagaattaataaacccagttctggtttcattatttggaaccttggtgtattaagtataccactgaaaataattttgatgggccagtgcagtttaggtcttcagtctaacactctcccaactgagctacttaggctactctggccagtgcagtttaataagtgcccttttaacgctaagcatgctggctagatgttcatattttacaaaatgtaaaatatgatttttctctaccctcaaggagttgatgcaggtaacataatcacatgatagatgcttgcgatatctttaaaatgagacctaaataaaatttaagggattcattcaaacatttattctcaggtccagtgggtgaacatagtacgtatctcataaatatttattaaatgcagtgaagcagtttttgtagtgcaaacagagcctttaaatggttgggcaaattataacaggaattctagaatatggtgggttaaaataggaagttatgtatggcaataatgagttttaaaccaggtttgcaagaagtagagataaacatttatacagatgatgaggaagtgcatgtattttggataagatggcaaaagcaaggacataaaaataatgattaattgcttgcaagtgatgacaaacatctgcaacacaagtggataatgatgggcaagacggtgctgacaagcacaaaggaataggatttgccacttgaagggggtcattgttgaaacagtttggtttgagagaccagaatcagagaggcaggaaaggagtctaggcttgaagcaattagcatagtggctgtccaaatcgaaagagggttctaaaaaatacataccagcagaaaaaaacaaagtatcatgatttggtgatgtatttaatttccaagaaggagttcttttagatggtgtcactgaggagggggagatgagtgactaaatatagcaggaaataaagagctttgaaattaagacttgctaagttatctatataattttgttctgcatacaaatagagatattaaacatagtgctggagagcatggccaaacctgggaatgtcaatttcattttgttcttttacttatatcttgtatagaaagccatataaggagtcaagccaagaaaacaaaggaagaaaatcatcagttcaaggggaaataagaagctggtagttaatgaataccacggaaagaagtcagagacaggacaactgaaagcctaatgtcatcgaatactaagatagaaacaatttcaagaggaaggttttcattttagttgagggatctagaatgaagactatataaaattatgtaataggtaatgtaatttacgtgtgtttatgaaaccagaacgcattagtaatttaaaagttctaggagaatgctgggacagaagccagtggaggtgggaagcggaggtagcaaggggtgaggaactgaaggacctgggcctaacagtcatttgcagctgctgaaaaaaatgattcattttcactcttaaatgagtaattacataatgttattcaagagttaaaagatgactttctactcttcatttttaaatgattttattactttcttgaaaagtgagtatacatgcttttctggacataagatacttggcagtcttgacaggtttttatttgtgcagtggaaagaatttgatcgttaagggagactcttaaattgttaagtaaacatattcacttttggagccagaattttattttgaacgcatgaagccttatgagaaatagtacattttataatgtgctctaataaagggaaaatgtgtcctctcaaaataattgaatttcttctctaattttttatgtatatgtgatctctaaagctacagttttataattattcttaccagacaaatattactctgacctaaaatgatttagagtagaaatttccaaaccagtttagtatctttttaggaacagtgaaataacctttggttattttagtagtaaattaaatattcagggtttgtgtggatttataggacgggggtaaacatgccaagtcacatagtgggcatgtgtaaaatatttagactttaatagaaagaaaaaccaacctgtattgagttataaaaacaccatactgttgaaatgattgatggttttctcatcacatgtaacagactaacataatttcatgaaacctttgcttaccgcttacaaattatccaaaattcttttgcagtaaagctaacagtatgtgctccttaagcaaaacattgcctatttcttttcttttctcctctttcttccttactccttcccttccctccttattccttccattcccctctcctcctctcgccctgttccttccctccctcccttcctttcttcctccctccttccttttcttcccttcctcccttcctcccttcctctttctttcctcctctctcccccttctgggatgttgccttaatagaaataacagtctactagagaaactcaaaacatgtaaaaaatattatacaaggtagaaaatgataaaatgtgtaagaggagtaaagaccaaattctgttggagaaagcagaaactctcagctgggaagattaggaagggctttagtagagacacatttcaaaggtgtgaatgtcttaattctcactatattcctctagaaactcatgaccaccgttcggacaatgtagtattataaattgttaatagcgagggctgtatctttgtaatgatgatgttgttacgtgagatacttggccttttgaataaccataggtattcaaatatttcagtaataaataagagtgtttctcaaagatgagctatagctttgtttttgtcatgtttaactagccatgataaccagctgagattgacaggagttacttaggttatcctgtgatcaatttttggatgtggaatcatatgaggtcattggtactatctttaaaattctgcccttttttgccttgatgagggacagtgctgggtgacagtatcctcagtgctctcctctgctgggcgttgtgagtcaggagctcaccaaacaataaatcatattgtagtgcgtgcatacagatgtcagattccaggggaaaaaatggttataatttttgacttcatggaaaagtgaatgggatggagtgctcaaagtgttgcatgacgtaaaataccccgttatctatgttagttgtgcgaaaaattgcatgaaaaatacatttaaagtgacgttgtgaatgacagagtttctgagatggtaccttatgaagggacttggcaaccttggtggtatcttaggcatcgtatcaagcttaaacttgctaactcttggcctggggagcaccagctcacactggatgctgaactgcacacttgtcatttcatgacctctcccagccgctgcagttgtgtttcatgcctgcttgtgtttttgttaccttgcctcttgccttcccaggatagggcacatagtagatacaggaacatttttgagaataaaaaggtaatttaacctacacagatgtacatagtacttcatatctactatttcagaacactgtagcaaatcaagaactttaaattattttcctgaactcagttttgaggcagtcagcctgctcctggtttttaaatactgtgttttgcaaacaaaaatgtataatgaggtttttctctgaatacagtgtggtcagtactttttaattaataaagtaaacgttaaggcaaaaaactacctccacaaaaccattaacagacaaatattttatgtaaaccttaggagatgtttattaatcgtggttcggcttggggcacataggatgtttgtcaggttagtgaataaatttccctaatgtatgtcactgaatattgttaaacaatactctacctgcttaattccattactttaaaaattgcagtgaaatttatgtgtgtgtgtgtgtgtcttttgtagaaaagttattacaatttacgatcaaactcactagccataaatgtttttgattaatttatataaacatgatactgtggtagttttggtatgtagaatatttatatttatatttttgtcagtatatttcattaatgttcaaatggtagtggcggatagtgttttcaaatttgttgaaggattgcgttgaaattcttgaaacatggtagtgaaaattgcattttttccagtcttttcttttaaaggtgaattatattcagttgattataagaagtcccaaggaagtactttttactagctttaaactgttcaccatagatgttaatgtgggacacctacagaatccacttttgacatggggcaggttgcaatagtattgcattacactgtcagcaggtgctgccatggacattggtgtaaagtaagaaggaagggattgggatgcagaacagtaattggaaagagagaaataaatccttctctttcagttgcttcactgattcccaatgttccaggtaaagtgcacctgctgagtgcctgagaagaacaggtacatgctagccctccattaatttcagaggaatggcagtggactgcatctacccagcaggtgtgctgagctgaaggaagaagatggatggggacagagtatagaaaagaaagcaggtagcccagatagggtggttctcaaaataagagacaataagggtaggatctctccttataagcttgaatttatcctcctctaattcctagtggcactatacattttaatagtatttgaagccacgttagaattatgacagcatatgttaaaattgtgcaagtggttcagtaatataagctaacatttcctgaaatgatttaaaaatctggcagactgcaaagttatcctgataaggaacttggttttgattacagtaatgagatatacgggatggtgtcagaaactgtcttccagttgacacaataatccataatttatagattggcttaaaaattaaaagacaaagtcaattataactaattatgatgctacatttgctcgaggagttactatatcctttgggataaaggaagtaatattcatgtcagtcaggaatctttagctacagtttcctggttctatcttaagaatttttcagtttcgtttcatgagaatcctaagccactgaaagcctgaaaccctgctatttttagaaatactgtagtagcttctgtgtatcactgcacatttgttcctattctgaacttcttatctgtgccaaatcttcagagaggttactggaagttttgctcgatgactgctgaatcagtcagaagtgaattttaaattatgcaggagaaaataacaataaactgagttacagcatcaagatatcattgttatttctgttgatactggtttcatcacttgataggatttaaatacccagactattgcatatttactaaagttttatttcatcatgtcaacatttttttttttttacagtcaaaagccaaattgtcagcaaaggatattacaaggataggtatttttagcatcttttcaagaagtgaaaggaaggagtggtttatatttttctataattttatgccatgagacgtgacaattttccatcttaagaaggacaattagttcttagaaggaaagaaaaatgcattcttatataaacttcctagaaaatttagtgagttgataaattcctagctgcatatcaactttctactcttgtggccttcttttgtgtgagctttgatcatcaagcagtttctaagtgtttttgaagcacatgtgttgcatgtgtggagcaggccacagtgcatatatgtagcatgggcttcttccagaaaaaaagcattctgagagtaccattgagggaatatgtattcaaaggagacaagctgcaataaactagttgtttaagtaatattataaattgttatcctttttagatatttaggatttcattttgttggaaagctttcaaagggtgacccagtacgtgtgccaatgacaaaagctccttggaacaattcagagcatgctttatgccttatgaaatgggattgtaaaaatcctctcaaaaatgacatccaaaatagcattaaaacacaatttcctttgataaggctttacggcactcatatgaaaagtgataccactttgagtgagactgtgtcagcattatgtgatgttgtgttgctcataactgacactaatccattaagggtgtgagggtcatttatttttcttatgaagtcattaaatacagttattgatttctgttcagttagattgtaccttcatttaatgatcgctatatacattaatgctaagacttgatttcatgcactttaaacaaatagatattgtatttggagtttaaaataaagttaatgacaattattaaaaagaaattgtcattgattcactaacccaagatcatgttgacctagaactgtaaaaataatattggttttttaaaaatttataaccatcttcagtgtatttgctaaatagaacagatgacttttatttcttaaattaataaagtaaaattaataaaactagtatgcaggtctatgtagtattcccctcttactgctactgtttttataactagttgtattattttctgctgatttgcagatgggtttcgtgcattttctaatttcctattttttgccaagtaaatgaaaaaagagtaaatacctaaccaaaatcctttttcttgagtgtgttaagcaagaaactgggaaaggaaaatgaaaagacatcagtgtatgatattctgttctggaaacgtagatgaatattactagggaccagatgtgttttggtatatacagtagtcccccctgatcacttttggcagtttcagttacccatggtaaaccacggtttgaaaataaagtgcatacagtacagtgaggtactttgtgagagagaaaccacattcacataacttttgttagttatactgttataattgttctattttattactggttattgttgttcatctcttactgcctaatttataaatcaaacctttcctaggtgtatttaaggacaaagcaagtatatatagcgttcagtttcaggtatccactgggggtcttggaaggtatttcttgcaaataaggggcgactaatgtaatctattttatattaaattgcttgtttaattggaatcatgcagaattgatgtttctgtacattcccttgaaataattttgtcaaaagaaacagcagtataaagacttctgtaatttcagatttctgtcatttattaagaccagtcattttttccctgattgaatatattatatttgtgttttactcgaaggtatgccttaatagtaccaggaacttctaaactttcatagtttggcaatgttttaaattatttcttttacctatccttttggaatttgatgcagaaattattggtctatgcaatagtgagatgacgtttattagatcacctttcacatgggaagtactattggaggtctttagcctctagtgcagtagcaccaagtggtaccaagttcattacagcagcatctttggagatgttgtatgctcagcactttttcataggcatcttgcctggctcattgaaggaaacctgggcaaggctgtgatattaatgaattatgacaagccttttgcctgtcaagcagaggttcccgccttcctcctttaagacaaaaacttaatggaagatgctcagatgcgcgagctctctgatgataccccttaagtgctcttctctttctgatgcgaatattcagagagccgtgaagctgcaagtggcagcatttaatattgcctttctcataatgcctgaataattttccagagactgatctctgcagctgctgtgaacatggttatttgtttatttttcaccttggtcctggtggaatgctgacctagccaatcttcaggactcacagggaaaatggtttcagattcatagctctcatcttttctttcaaataaacacaaaactgaagcttgtgacgttgagtaacagaaaaataagagggactgtttctttagtttcctttaaaagtgaaaaaaaaaatgactgtatgaatgaagaatttatttggtgaaaaatgaagactctcttgcatatttttaatggatatttgtgagaggaaaggagaaagcataggctgttgtggtaagctatagaatgttttcaagatttccccccgtagtgctgctcattatgttaaacagtctagcttttagctactgtagttttcgttttatgtgtattggccttcatttgctgaaatgcttcaagttcacagtactaaagtcattttgaaaacgggatgtaattacaaaggtatcttatgcttaccaacagcttttttggatcaatttaattatcattacttgtggatactgtaaattgaatatcccgtccctaattacattaaactcaggggttagctgcttaaacgtctaaatgagaaaagttcatcctttgctataaataggagaattgttctcttatttagactgaccttggaagctaagcattttacatgatattgtcaggtgagcattataaagacagcctgtaatgagatctgtaatgaggaactaaggtatagtagccctttgaaaagttaatttattcagcattttcttattgcatgatagaattaaagtttgtgtatatgtccggacccctttttaaaggggccagtctcactgttcttggtttactcatattctgccagtagtttgaagtgggttagtattactattccaccttaatggaagtcaccattaaagtagtgaattcatcttgcccttttaaacagagctaatttatttagggagtaggaatgttattttccctaccttctcctcacttccttttacagaaatgatatatcagaatttattcaaaccactttaagcatacattttcctgagaggaaaaaaaaaatgcctttagacatcaataaactggaacggcatttccctgttctggaaaatcagcctttaattagttgatgtgtgtgtcttgggttagtatttgttgtctgttcagctcaagtgatttttgtgctttataagaaaacggattgttctggtgggagatttgattgatttctgcttgttatagtcattgtaaattttagtgccatgcatagctacttgcttttatttactttgttttctttgtcaattgtagcttcattaaaaatctcttatctgttcacagtggaaactcttaaaaatgtaagcgtaactacttatttccatagaacagctcctgctgagtgtgctttacgatttatcataaaaacctgtaaggacaaattgaggctggatgtgctaggaaatgaagccgtccctgggatcactagaagagatttctattatgcaaaagaagtagctaaaatgattgattttgagacttcagtcaaaacataccctgaatgttttctggattttctaatgagacatattgtagaatacaccagaataacgtgaaaaatgtagacttagtagcataaataattaacaagtggttttgggctctggggtttccaaagcaattccatgttatactaagtatactgggagccatccacttacagctttttttttttttgagacggagtcttgctctgtcgccaggctggaatgcagtggcacgatctcagctcactgtaacctccgcctcccgggttcaagcgattcccctgcctcagcctcccaagtagctgggactcaggcacgcgccaccatgcccggccaattttttttttattttagtagacggggtttcaccatgttggccaagatggccttgatctcctgacctagtgatctgtccgcctctacctccaaaagtgctgggattacaggcgtgagccacggcacccggcctcacttacagcttttaaaaatattttcaaccatactaaattccagaaatttacttttagtgtgctatactaaataacaaaacaacaattctagaaaacttgaatttaagtatagtgtgtcttttaatatcttttaaaactagttttctaaaaatatggaacattttacacatatcactttagtggttaaagttatgaaattgaatgttcatacaactggcagttttcctcatcaattcaaacaggcagtgagctttggatgaaactacatttctaatattagaggactaatcataggcaacctaactttttaaaaacaggcaacaattttatgcttccgatacaattagatacagttaccaatcatatcagtccattagctgtcaagttttattcttcttcataaaaagcaatcagaggtagacatttaaacatagattatgtagacacgtgatgtatatatatatgtagcatataccccatctctactaaaaatacatatatatatatatatatatatatatatatatatatctcaacctagatgtatatagattagataggaatttcacaaagccttgtacatgtaactcctccagaaaatgagtcttggtaagaatacttagatatcagttgttgagtaatgaaaactcaggatcatgaaaagtaagaattgttagaaggtgatttggggcatcagtgcatatgatgcttttcctattcaaaattaagtagagaaagcatttttgtggaagatggagagtggttatcttcattagcatatagatgcctcatagttaaaaaagagttgacgttctcagtccagagtttgtgggaccaaaatatatctaagacataggcttcttggaaggaaggctgactcgtaatttctttaacacctagtgaaacacccagatgtaagtgttttgatgttggtaatgataattgacacacactaaatttagctcagaaattaaggcctattaggaaaactgcacttcatcattcgtcttcacctcttgagaaatttgtgtacattgtggaatatttatgctgttctccatgttcagttaatagtgtcacgatccattcccatcactctaattaggtttcaccgagatggtacccaattgggcagttttgtgaacacttttcttccattagctttttcagtggcttcctatgtaccctcagattctattaaaatttttctcaggatcttggccgggcgtggtgtctcacgcctgtaatcccagcactttgtgaggccgaggcaggcagatcacctgaggtcaggagtttgagaccagcctggcaaacatggtgaaaccccgtctctactaaaaatacagaaaattagccgggcgtggtggcgtgtgcctgtaatcccagctactccagaggctgaggcaggagagttgctcgaaccctggaggcggaggttgcagtgagttgagattgtgccattgcactccatcttaggcagcaagagtgaaactccatctaaaaaaaaaaaaaattctcagcgtcttattaagagtcagttttaaaatacttctagacttcagtgcacaggatggtttataaagcagcatttgtgaaaagtttgccattaggcaagtttctaaagagatctcaggagtcttaagttatatcaagtatttgccaaaacttggaggtgctcagtagtataattctggtagaagcctgaaaataaaggcatagagtttttactttgcacagtttgtggtcattcaatgtacttcaacagtggtaggactgtgaaatgatttgatttggtagtagaaacattcctctggtaaggaagaagtgaatgaggttatctaatccagggtgatctgaacaatgtcactaaaattggaggttaaagaactcaatatttagggtaacaaaaaagaaaataaattacagcctcaattgcaaaagatacctgaacatgtaatttttacaattacgctctgaagtgttggtcccactttgcagatggcttagcttagtctcacaggagttctagcagaggccttccccaacaacacagaactgagaaggagactgtctggtatttgaacccaggtttatgtcactgcagaggctttcagtgaaaagctgcctacccaactctattagagcccatgggtttggctggcagtataaagacaaagaagaaatactgagaaagagaaacccttcccctcctgcctcttttcctgttccttttttgtgagtcccttgcatcacagcctaccaccagattaatttcccatcatcttcattacttgtcctaaactcatagcaaattaaaaagttctagtactttcattgctcacagcacctaagaactaaaagaaatagacaactgatgacagaatatgaagtttaatagcattttctaacgaactgaaaattgaataaacccaaccacaagccagattcccagctactaaaatctccactacccttctcccaaaatctattttttctttataacatttacagactataataatgctgtatacataaacattgagtagtaaatgtcatcataaagtatttatgtgattttaaggggaaatgtacaaaagctttttccatcatgtacctcctgaattagcaatagggccaaaatccaaacgagtgaaaagtaattgtttaagacacttatacgacttctggtttatataaccatcaaaatattgcttctaagtgttagaagttgttctgctgtgtgtctgaagcatgggatcccagaagcaaatactcaagtagctaaggcataatgggcccaagtaaatttttgggattgatcaatgaattaattgagaaatactgagaaaatacacgataacttgacaaagaagagctttaaaaagaagctttagaaagagacaagtaaatgagttcatggtaagtatgagagagggtcagtattcttaatatataaagagctcttacagatcagtaaatttaaaaagggacaatagaaaaatgaggaatttgtaagggacatggatagctaacaacgagaaaaatggtcagcattattaatgattaatgaaattgaagagcagtgagatatatttcatttttcacattgccaaagattttaaaagattgctaacatcactgtcatatgcttctgatgggatttgtttactggtgaatgctttaagcacaatttagcagtatatgtttaaaattttttaaagcaagaatatatcatctgacttaggaatttgtatttgaaattcaggaatttaagtaaataattagaaaacgtgtacacaaacatattgtaagagagacaaatgtatggggagagaaatgcatacatgcaaacacatgagaacatttatcagcactgtttgtaattgccaaaaaaagaaaatctcaatggccaacaggatagaggattgattaaataaagtacacggtttcacatgataatcctagaaagttctgatatagatttatatgatctctaataattattaagataatttagggtatattaagaagaaaaattggttataggagatgtttttatttaatatatactctgcatatttgagtggaaaaagtacaacctaatatttctgggtggagagagttggagagatttcctttatttctttatttagtcttgatttctttgactcttctaacttttctagaatggtgagcatgtcttatgtatgtacaaagtgaggagaaagccacacagcattggtcatcgaatgatttaatccactcttaaaattctagaaaaagttatatcaaacaaatacttgtcttgcttgggtagtaagagccaaataatacaggtatctttagttcaacagcggcaccttctgtgttcagtagagtgcttaattagcacagtcatcctgataacatgaaatcaatccataaacaggcaataagaaatgtaaaatgaaaagagaaaaatttagagttcaaaagtgctcttgaggttaaaaaaatagttaaagctatgtctaaaagtgggggggggggttggcaattaatcttattactacatgacatcttaggtatattaacagtgttttatccagaatttataaatatcctgagttgagtcatattttagagtatttgttttttcataaatttttaaaaattaaagtcatttggatacatagtaaatcaaatagcattgaaaggtccatcaggaagaatgtactgtcaccccatcccatttccttatccagaagcaactactcagcaattttagctgttcatttgatagttacatccattttacctgaagatatatcattatttcttaatgtttcattttaaatattatctgttgacatcttgtaacatgaggacccatctttattataagcttgtctgcatacttttctccattctggcgatatagttatatgactttttttagtcattaagtgtatattgttaactttaaagccatagattgtactcaaattgtatttattcttttcattcagctctttgatttttcttcttttacttgagcatgttcttgagtcttaatttacttcctctaagggaagtaaattttctgagtccttaagtatctaaagtaaactttttttctgcccctacatttgttggatcacttgtatggaaaccacttgtgtgaaatcatttgctgtcagaattgtgaactgtggaaatcacttgtatggaaactcacttgtctgaaaatcatttgctctcagaattgtgaaggcactgctccattgtcttttactgtctgctactgttgttgaaatgtctactgccattgtcattcttccttgattatattctgcttaaaccctaccaccctgcacctcaaggaagcgtttaggatggcgactttgttccaggagttgtggcctttcatgaggatgctgggggcggcagaggcggtgctgtgtacttcattcattgtgctgagtactctgtgggtgttttaaagttggaaactcacaccctctgttatggtaaattttcttagagtatttcgttggtaattttttccttctattttgcagttttctctttctggacctcacattcattggatattggactccctttgttgattctccagtttacagttttcttctttcacattttctccttttcaagttttcattgtacattctcagagatcactcatcttttgtttctgatttttactgaattttcttttattttgacatgatgtttttaattttcaagacctctttttttattatttatttgtcataacatgctggttttgtacttggataccgtatcctcttttaactctgagaatgttaccatttttggttcttcaatttaagtttttctgttccctgcattatccatctatttttggtctcttttatgccaatattttctttcctcatatgtcagatgatccttggttattcatgtgtattaaattgtgggatgctaagggttaatttgtagctctgtgggcatgggttggagcttttaattggtgggcttcactgttttgtgattggatgaagtcagccttttttttttttttttttttttttttacttacctgcatatgtctgtatgtgaatgtcctttatctgaaactggtttatttcttcttaaaataatcttctgctctcttgtccaaagtttagacaatccatctgctaatgagattgagaaagggaattattggttcaactattccttatttcaagctacagttcatttcacctctgccttccagtaagtccccaaatctccctcattctttttctccagcaaatacaccagtggtttcttgctttgggtgaggactggggagagtgtatacatgtggctgctggaattctttacatttagatgggcatggttttatatttagactttcaacctgtcccaaacttctcttctgccatttgtcttacagggacattcagtctttagcgtctccagggactcaggtttcttctcattgcttcagtgggttcagttggcagactctgcccctcagttattcctctccagttttgctggccccttgcttatttgtgtgtataggttagacatacttctgctgcagggtctttgcattcatgaaatgcacttactacatatatactcatttttttctgccccaagtaacaatccccaaatctgaagaatttgtattacttaaggattgcaggttggcagtggcattcctgggattggcaggctcaggtccacacatctcatttcaagatccaggtaatttttctggattagatggttttcacggtagagggcagaaactcaagggaggacagagccaaatttagccaatgcacttaaagcttctgtgtagctgtgacacaccctgtgagcccatattccataggtcaagacaaattgcatgggaaatatgatgaggaaagaaaaaataatgagtaattcaacctactacaccccagatatccacgagacttactccttacttccttcaaatctttgttctaatatcaccatctctgtgatgccctccctaattccaccctatttaaagttttattactcttctattttctgtttcccttccctgatttatttttgttcctaacacttcatactatctgacatattatctaatttacatatatatatatttttattttatttactgcctttcccaactagaatatttgtaagcaccacaagcccagagatgttggtttttgtttattactgtgtactcagtacccagaatagtgcctgacgcccggaaactgctcaaacatatctaaatatcccttccttcccatggaacttttttttttttcttaaattttaaaatcactcatcccctgatgaatctgcatccattttctttggtttttgtggtttataccttcactattattaaaggctctgtgcagagagagacgtaaatgctttttatcaaattagccattcttaactacaaatctgacttcttaaatatttattaaataaagaaagactcttgatttaatgtgctggctttcatacaaattaccaaatacagatttgattgggatgtttctccagagttaagtcctctgtaaaagtgttggagtaaatgaattacttagcataatagctatacaagatatgttttggttggtgatgccaccctctgtgaataggtgatttcttgtttgtccttcatttgaaaaagtaacataatagtcaacctacttgaaagcgaattagttcttattcgcatgcgaatgaagaggcctaggtgggattaaaagcattttctattactgaatacatatggcgttcgtaatttgtattcaaagacctgtttgctatttttggcatggcttccaacctcataaatgcaaaaagcagctccacttcttatagcaatatgccagcctggtctgtcaactacagttatttcccatcagttattcatagtcttagactttgtttcagtaaattgttctgcattgtttactgccctcactacttattatctccccagcccaggtcataatacaacagatacttgggtatcatgatgttatatattcttttccaactcagcatggtgatattgggagggtgatcttattcctgtttttcatatgggagattgatgaaacttgtttttcattttttattacatcataatacttatttgctgacaaactcatcaggactctgagggagccataaatttgtatcagtataatcaatattgatggaaacactttgaaactcctcctgtagaattagagtcagcttacaagccacattacaatggtcttatgattatataccagactcttagttctatgttaatttagtatgaatgtctatataccctagcatttttttactccaaataatgtttatttcccaaaataaatttcattctgcaaagatgaaaatctgtatcacacctaaaattgtgcaatacagatcttaaaactgccagatagcattccaaagtgcttactttggaaggaaaataattaaatgtctaaattattatacatttttttaaagatttctttattgctgtaattcttactgcttcctctgcttttccttttattttattttattttactattactattatttttttgagacagagtttcacccttattgcccaggctggagtgcaatggcgcaacctcagctcactgcaacctccacctcccaggttcaagcgattctcctgcctcagcctcccgagtagctgggattacaggcacccactaccacgcccggctatttttttttattttcagtagagacggggtttcaccatgttggccaggctggtctcaaactcttggccttccaaggtgctgggattacaggcgtgagccaccacacccggcctgcttttctttttcaaacccaaatcttagattcagtttcctcatgacattgtcaccaccttgatataaatcattcctttgttgacattgtcatcatgtgcttactgaaacatgccctacataacaaggtagaaagagacaggcttcggatttcttcctgttaaagcaaagcattaattttctctaaggaaaggtagatgttgagtgtgaaataaacttaaaagaggatgcatcacatataaaatcccagaatgttacaagtggaggggacctaagatgattgcaaataaagataaatgcaacagctgtggtctagaaggaggcacaaattattaagagctcagcaagacggagtcaaggaaaaattctgactgagcatgaacagtgtgttgcttaatagttacttaccatcggcttcactttagccctgtgcatatgaccccgaaaccatgtttataatgtgtaagcccctttgattgtttttgtttttgttctgaagacgcttgctacttttgaaatgttttccatatttagagataatacggtgtggtcgaaagagggcatattttggagtcagaaaacttgaagttcaatcttgtcattaccttaagctaaatttctccatctgtaaaatgggagtagtaacatttaaataacgattaaataataaggagaagtaacgtaggaagagattcaagcactggcctggcacatggtgcttaaaaagtgtcttgctctttctctctcccttctttattatttaataaaatttgtctggtatgtgtattataatttgtacatcttgatcttatatactgtattaaaattaaaaaatagtcaaaagctgaatgcctggtctcaaatattttaaattctggttgggatgtaacataagtacatgtactccaaatatatttacagagtaggttttattaaatgaactaatagatattgtacataaaagattaaagtgaaagaatgatcaggttgtaaggagtatggagtaggtgaacttggcgctgtatacgaaaaccttccatggaagagctcgagacatctttttgaacttccttaactctgttttgatagtacttaaacggtcaattcgatggttcttcataccttaaagatcactggcctttattatcctgatagtagtgaatataagcatgttaaggttatcttatctgtgtttaatcttcataggcacatactatggaacatctttatctgtcatattcatgatccgtgaagcctcttttgaagtcaggttgcatactgcaaaaaagtagagctctaaagtaggtcacagtcctaagagagacactggaatcaacatctgaaattgaaaagctattctccattcgtattaagtttttaggttatcactaaggaaaaaaaaagcacactaaaattagatgaagtaaaagaagcccgagttattcaaaatgtaaagaccttagaatgaatgctaacatttttcttttgccctttttcttccatcattatgtctaaagattgaagttagtctaaataacattaggtcccataatctctgagaatttaccagctttactgttttctttttctttctgttccaagtacatctgcccttatgccattactcttgtcagaaactcattgccaagtgtctttaaaaatcagttactgtggagttacctatttcaaaacagaactaacccctcagtttgatttttcaggagtcattctttcataggcaattccgtcagaattttttttatataaatcagtgtgaaagcattggattttcttaatacagtcttgtccaggaagctgttaaagctttttccccattgaagagagaacactaaattgtcagtatgtactcattctatgggagaagttttgaaagcagaggtttataaattttcaacttagagaacgagattctttgcaaaagatttggtcaaatatctggaagtcttccacttttgaaatacagggcttccaaacacatttcttcaaatgtcttctatatagttactgtcttttattttggcaagttatgccaaagagacgaaatagatcttagagaccttagaatattaatatccttaggttacattcttatagagtatccactaattatttcacatacttaagtgatgaatatattagtatcttaaattctagtttggtcatagagatttgtgctttcatgggtcctggagcagatggttgctgtcccccgagtggttcatactcaggctctggtatcaggtttcctgggatggaatcctagttctgtcactaactaactgggtggactgaaacagttcatttaaccctgataggcctcgtctttgtaaaatggggataaatactacctatcttgttgagctgttataaggatgagacataccacatgtaatattgacaatgcctggctcacagtaaatgctccataaatgttagccatcattattgttgttattgatgatggtttttggaaggctcacttgaattttctcagttataaatattgtgtagggcaaggtctgtgaaccttggtttcattaaagtaactattcctataagagtatgctccgctgtgattatggttgtataaatctcatttggcaattgagtaccaataatacgatagtcatagattaggtataactatctaaattgaactgctgtcaacaactactgaaagagcattttgcaataattatcactatcatcattatttcaacttcatgaaatccatgaaatatttatctttccttatatctaatcagaatgatatactcttagatatcacataggtgagtaataaatgatagaatggggtccctttcttctgatagatgcatattagtatattctgatataatgatatgcagggtactaattagtgtgcaattaactgtcagactttgtgcaattgagtgagaaagattttgtgcagttaaataaatgatgaaatgggtcctttcttctttcctttgaatcacagtgacaacctaacttagactttcaattaagctttccagcttcctacctgtgttcttgtattggtttcttaggcaggaatattttctctgcatggacagaaacagttgataaactcaactccaacagagaaataaattacatgccagctataatgagatatgaacgtccagtaaattttcttttgcatgtaaaaatgtggcagtatgaagtaagagtcaataattatttattgttaattccctaatgtttgcttctgatgcacatgtaaattgtgatgtgactaaattgaatggaattatccgttatttttaacatattcactctaatgcacatggatgaaaatgactgtgataatctagcagggatcctttgtgttttggtgaagcatgtaggtccgcatcctgcagtctagtataaatggatttcaaaccgaatttaatgaaaattacctttgctgacagtgagcctgagacacagatggtcactgtatcctcagatgtgtttaactccatttcagtggggccacctttgttgtttataacttctaggtatagattcttgtgggagttccaagatttgttttaagcagtttttcctttcttaacaaaaatagtaagcaccatataatgcttgcttcgtttcagtgatattttttcattcttcactctctcttgcacatttatttgatgctcaagtgatgatatacaaatcactgagaatattatttcctagttttctggaatattagaaggacaatattacatagaattttactttcacatatataattatttcaataatgttgccagaagaattgagtatctcttctgaacaaatgccgtgtctaagaacaagaaggatagaattaaatcaatgaggggatggaaagtaaaaaatgggtcagacgcagtggctcacacctgtaatcccagcactttgggaggccaagacaggcggatcacctgaagttgggagttcaagaccagcctgaccaacatagagaaaccccatctctactaaaaatacaaaactagctgggggtggtggcgcatgcctgtaatcccagctacttgggaggctgaggcaaaagaatcacttgaacccaggaggcagaggttgccatgagccgagactgcgccattgcactccaacctggacaacaagagcaaaactctgtctcaaaaaaaaaaaaaaaaaaaaatgtagggagatacaggtatattgtttgtaattcagatctaagattatttctgaacctgaaccagaagatagacatttgaaacagaaattcacactgtcagttaagatcttagttgtgtttttgccaaatactgtaagattaaaacaaattctccaccaagttttagcctccagtttactgctaccaccatagttcagtcccttcagttggattatttttgttttgttttctaataaaatggccagattaatctagtttacattgctttatcaatcactgtgtttcttagaaaactacaaaagtatcctcatttcctctccatcagtactacctgttttcttctgcgcaagccttttttgctctagctcgcctctagccctctagccttattttctctactctgaagacaaaccccttggctttggttagctcctttacaatgtgattatgtcatgtcccacttgcctaaaagacttctcactataatccttagttttgaaatcctctttatcttttaagggttaacctctagaattgattaattttctagttattccagttctgattggcaattctatgctgttaagttctcttatacatacatgtagcatttaattatattatggataatgtgaatcttacaatcaatgacatttccctatttgtccttaccactaggaagtgcagggctgagttatcggccagtctttagttactgtagagaatcttcgacatgtatttctgcctatgaacttcccctatagcattgtcttaaccataaagcttcttttttgcaacatttttttctaatgttataatcttattatatattctatcttcttgtaagccacatcaaatccttattaggagaggcagtcttccatgggatctgagcgcatcctgcacacccttgctggccttgccaaaaatgtaagtccctgactgctctttacccaggagatttctcaggatggtttgtagcaagaaaccttgagagatgaggcattagccaagagcaggcttgttactacttactgtcaaacagtggattccccaagctcagtgttcctcagctgtgacaagcccattgtgtgcatagcatccatttgggcctgccagagttggggaacaaagggaccaacgtacaatccaatactcatgctgcttgctgtgctatgccatgagtttttgccccttacccaggagttttgtgtcaccatttatgacagcaggaggctgtagtaggctgtaattaggataaaatcaaatactatactaatactcatttatggaagatagaaactgttccataaattaataaaaataaacgtgttttgagcctttcaaaccaacccactgtgcatatcactatcctgaacatgctgaacatgtaattagatgtcagtgtatacttattatgctttgaagaacttagcttttatggaatcatggcagctgcaagagtaattaaattgataatttcttggaattatgttgagaagacttaagatattaaaactggctggatttgtctgcttcaactaaaaagatgaatagagaatatgtttaacttcaccttgcctctgagaggtttctgaagagaacttcagtgtaaaatttagtgtcttatttagttatctaccttagtctgtgttctctctcctttcatcagttgtgttgcttttttccatttttaaatttcattctcactggaattttgagaatgtagcatttgtaaatgtgaagaaaaatcagtaacataattttcaatttgtttaggttttttaaaactatggccttaaaagataaaattaggatcatataaataaatgacatatgacctctgaaggactgggtagaaaaaaattaatatttattgattaactagcaagtgctaagttcttttaaggtgctttacatgtattatatcattaaatctgccaataatctaagagttaagtattattaaaagaataaactagactattagaaaatgacactaattagatttaggtaactagcccaagttcatactgtaagtagcaaaagaagactctacccaggtagatcagacattctcatcaaaggcatggttcttaaccaggaactctcatctcctgggatagtgaaagtaaaggaggatgtggaagagactatttcatattaccagaacctatttttctgtcttccttgataaggctacatttcccagccctccccactcccttgcacgtaggtatggacatgtggctagttctctacaatggaatgtgaatggaagtgaggtaccaggccgaaaatgggccttctccatggtctctttttatttgctaaacggtaaaagcaaaggacctcagggaccgtagaagatgacagagtcaccagatgggaagagcccacgtctgagttaccacgtggaaagttgtcccattgaacaccagcattagactaaggttagaatgagaaagaaaagcttttgtcatgttacatcactaatatttcagggtttatttattaaaacagctcacattaccttaccaaaatagatgggtatgatcaaatgtcactactaggagcattagaggattttaaatatttgatgaaatcattatgacattagttatttttgagacttctaaaacatttgattattaccttgaatatatgaacgaaaagtattgtaattgctttataagaagaaaaaacactctgaaaataagagcatattgggagtgatatccagatagtcgtgacctggtccttgaactgcctctgtttaatctggggcaaatgacttaatccctctgagcctccctctcctaatgtgtaacatgaaacaatctaacctctttagggtggcagtaaaattgctataggctaagagtatacagaaacacagtagtttgtatactccttgaagatcaaaatagtgtccagtttatacgtctatactggtactgttttagcacataagaagtgtcagtaaatattgaatgaatttttggtggaataggacatgatatccttttagaaaacgttttggcattttgagtcaaaagccataaatatatatattcttgttgtcccagtattaatgcttaggatatttatgaataatccatgggaaggaagaagtgaggataggatagggttgcagaagcctcatttcaacctttggaaatagtctcagtgtttaactacagtggagtaatttggtaaattttcataaacttcacttgctgcaaagttttcctgctattaaaaggcaagtaagaaaaaccatattcgtacggtgaaagtttatactagaaaactatcagaagcataaaatacaaaacagctacatctttactaaaagcctggaaaaattaaatgtatactcagtaaagaattagaaggaaacatacatagaaaatggaaaacagtttgatatattagtgataggattatggaattatttttttctttcagttgcatttgcaaacaagatgggagaagaagctggaaaagaacataggctacctatttaaagatcctgaatgaaaaaaaaaaaaacctttgtgtttcattttgtaaggtttttaaaaaatagatctgggattaaatctggcttttagaaagataatttgtagtaagagagttagtaatagggagatggattagaatattactgcaataattcaggtgacagatgtggaggaactgtgtttcttatttcctgcgttttgttgctgtgacatctggggccttgctgaccctggagggactgcccctcctagtgtttgccagttctagagataataaataactcgcccacaagtgcacttttccaaaacaaatgaatcaacccagagcgcacacctcaaccatctcctttagtgggctttcacactctggtccattatccacctgccctgatcaccccagggccaggtacagagagctcttgtgcctcagagccaattgaaaatatctaaactaccaatcctaatgctttttactctgttttgcccatttcttcccaaggaaaccacaataaaggcttgtttagggtttcccctctctccctctgcctcctaaccaaccctgatgcttctttttgtggccctgttggggcggcatgccccctcctcttgggaaccgtgagtaacaagctgtattgtcagtggcagtcaccttctactctgctggccttactacacctcagagcttccactagtacactatatttttaaactaaatgttgtgcgcctaaatgaaagcagtgaaaatggggatgaggagaaacattcagagatgtgtaggagtgagaattacaggtttttgatggtgttaggatatgaagagtagggaaatggaaggagcagatgactactgacagatttctagcttgacagtattaactgtgagaaaacagactaagaaaaagaggtttcaaaggggaaagataataaattcgatttggaacctgcagagtttaggtgcctgaaagacatccatgtagaaatatctagtgagcagttatgaagatgtgtcctgaacagtggttttgaaacttttatgactatgaaacacagcaacaagtccattttacatccggccctatatgaagatatgatttcatatttcacagaacaatacgcctttcttagtgtgatgtagtctgatagtttctgtctgtgccattcattttgtttcattttttgtgtgtgctgtaagccactaaattgagttcatgaactactaaaagggcacaactcactctttggaaaacactgatctggagcattaaaaaaaaactcagacttggagagatttagaagtcataaatatacagatgttagtttaagctatgggatattttctaggggctgagatgcagatcaagaaaattgcccagattattgctccatagaataccaagcatttaaaatttttaaagcttacagagagagaggaagcagcaagagagagtgagaaacaatagtacatcctaatagtagactcagtcaattaatattgagaaaccaagaaaggagaacatttcaaagagggaataatcagcagtgtcaaatgccaataatgcacaataattttttatccagactaagaagacaatttatcatttaagccgtcactgatgataagtgaaaaagcaatttcagtagtgttctgggggagaataggttgcaatgggtgggaaaaatgaatcggaagtgaggaaagtgaggcaaagaagttagactgctttttcagagagtttggccttaaagggaaaatatattgatgtgggtgacagtcactaagtgaggcgcagaaaaaatccaagtgaaaactttggaacagggtggtttgtcaaggatgcatgttaaagacagaataattgtttgctgaatttttttgaaaaaaatagatgagagtgatgaacaggtggaaaaacagtaggaacaattaaaataagattacagccatttcagttatttagcttagaaatggacagcctagaaactgatagcaagaatcatctaataactgtagccctagattagaaagatgaaaaagtagtctgttgtatatatatatgaatacataaatgtatgtacatatgtacacaatatgtattttattaattactgtatataatatttcttaggtgtaaattagtttggagagacttaatatcaacctccttaagcagaaggatgaggtttaatgtaaggagaggagacttctgtaatacatatttttaatacatattttggatgatttagaatcagtcacctaagagaaatggaataaattactactgtaagttatttacaattctatgagtttgtgatgtctgtgatacagtaaaagtctaatacccatttaaaaggtttaaatagaatctgctacataaacttttcacattttacattagaaaaccttgtgattccacacacagctctaagaagcagctctataatgaccacattttcaccctacattaatctgcaatttcaagtcatagcgtggttatgctacagcaaaaagtttattgttgagtccaggagaagagcatgtcaatgcaaaagtcttaacatgatgctattttatcacaaatttaaccatgccattggtcagctgtgaccctaggcagagagttgactaaaaatccccacataatttgttgtgggagaatgcagtggttaattaatgtgagtgagtagaaatagcactggactgtgagttaggaactattcattctgcaaaacatcaaataagtcaatctcatctttaaattgaatgggaaatacctgtacttctatctcacaggcttttgattattattcaatgagataatgagtgtcgaaatcctttaaaaagttaacaaatgtataaacgtaagttggtagtattgtggttgtcatggttatatctactgaaagcactactctcagatttgcttaaaacagaaagttccagggtgctttggctaaatcccaatggtacttttataatgcctttattagttccctacctcacggccaaacactttttattagggttctttttcaaagttattacgaattttttttagagttggctgtactttcccattatttcataaagtctgtaacgtgtaagcagatgaattatgcctgtaaggccaggcgtaatggctcatgcctgtaatcccagcactttgggaggctgaggcgagtggatcactttaggtcaggagttctagactagcctggccaacatggtgaaaccccatctcctctaaaaatataaaaattagctgggcgtgatggcacacaccagtagtcccaactacatgggaggctgagacaggagaatcgcttgaacccaggaggcagaggttgcagtgagctgagatcatgccactgcactccagcttgggcaacagagcaagacccagtctcaaaaaaaaaaaaaatgtaggattattgtatatcacatgaaaaaaaccagagagttgttcatgttttctctggggtacatcctctttggagtaggaagaatgagtgtatttcatataagaaaaaaaataaggaatttcaaggcaggtaattcctattggattataaaatatgagacctgtgactgattcttagattttcaacagaaaaaaagataaaggaatagaaactctgcattttgaaagaacttctttcatcacttttactatggagccagaagcaaagatatgtccaaacccagccgagaatataaaaaacatagttggagacgcttatggaaacggccaaaaccataatctaaaagtagggaaaaggcttctgaagtgtcgtgattgttgtctcagagcttcacggtagcactagaattcagcaggctcttcggcctcttttctgtagtctgttatttggtttaaaaaaaaacaaagttcattcttttttttttttttttttttttgagacggagtctcgctctgtcgcccaggctggagtgcagtggtgcgatctcggctcgctgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaacaaagttcattctaacataatagataatagtcaacatagtatggttctaggagaagagattgaagtttagccaatttttataccttatttgcatacctatacttaacattcatcttcaattatttcaaaataatgtgttgcaaatactcatagtacactgaaaaagctgtaattctactaatgcatataaaacaaatttagaagtatataaccatgagtgaaaccacacgttaatctacctggaaacaaatacaaatagtcccctacatgtccaaacagtgctgcctctgcttgcttcaccaacaccactacttgatgaagactccctagatcctctttttcttgatctttttccttctcttttctttttcttgttctttttgtttctgaagccttggaagccttcaattcatattcataggagtctactgtgttcatggtgcctgggacctcatagtaataaaagtctttgggaatcttattggaatcaggtacaccctggaaacactcaaatcatcaggaaacaccagacagtataatagaaggtgactgtgataggcagaattccaagatggcccccaagattcccacccctgggtgcgcccattctgtatgaatcgtgactgtgagtgggatctgtgaatatgatggaatatcactccagtgagtatcttatgttatatgggaaaggggtttgtaagcataattaaggtccctaatcagttgactctgcattcatctagtgggagatcatcttgggtgggccagacctaattgaaagagcccttaaaaaagataagaagcagcagcagatgctttccagttagcctaaaaaaaaaaaatagcaaactgctgtgttatgaagctgctgttagagagaggtggcctctagggcctgagggcctcagtcccatagctgcaaggaagtgagttctgccaacgacctggatgaattgcaaggaaatccccaaactctagatgagaactgcagctcagctgacaccttgatttcaacctggtaagatcctgaatagaggaccagtaactcagacctggaccttcctgacccctgcaaactgtaagatcataaatttgttgttctaactggctaagattaaatggtaatttgttacttagcaataaaaaattaatatagctacacagagaataaaatcaaagagtacctgagaatcccaaacctattaaggaaaacaactaataataacttatttatttagtacctgctgtgtacggggcatatactggaagttttttctaattctcactgcaggttttatgaacaaaactaagactcagtaaaatgttgaaacttacccaagttccttcccagtccacccattacactgtccagtgtggtaaccagtagccaatgtagccatcaagcacttgcatagtgtccaagctgaattgagatgaactgcaagtgtgaaataaacactgcattttgaagctttagtgccaaaaaaaaaaatgtaaaatatgtcaattattgttatgtattgattccatgctaaaattaatattttggatctctcatattaagtaaactgcattattcaaattaatttcacctgcttttaaaaacttttaaatgtgggtattaaaaagttacgattatgtgtgtggttcatttatatctctgttggaaagagaagaatttgaaaaacaagaaagaaaatgaaactcacatcccactactcagaaataagcattgttaatattttcatatactcccgttctgttatttttaaggtagaaatttttctttccctctccacagtttatttcagtatctcaggaaacatttgtaggggcaagagaaagcaaccccaggaaagcttaaaatgcttgcctgagacgttacatttgttaagtgaaggagctgaaatccaatcccatgtctttctgagaattccacttctatttgcttccaagacctgtgctctttctgctgtagcacagtacatctcttcaaaaacctttacaagaaaaattaaaagatgacttacagtattacataatccaaagtattgagcagaaaagaaaactcatcagggcctgaagttttacatttttatggatagttttatttgggaaggaaatatttctatatttcagaatttctaacggaatttctaaacattggtgactacttatgtttatacagttgttgtatttgggaaaaaacctctgtatttcaaaatttctaagtgaatggctaaacattggtgactaccaatgtttataggattgtttgtaatttttttcctaaaatttattgaagaggtataggtgggcaggggatgctggatatagttaatgttggctgttaatgctagcaattattaataggtatgtatagaattaagcaaataattgctttagagataattttttaaaaatgaaatttgaaggaaaagaaagatacagataggaaggaagaacgaaaattgtcttcgtttgcagactacatgatcttgtcttagaaaatcttaaggaatctttaaaaaaaaatttctggttgagcaaggtcataagatacaagaccagtataaaaaaatcaattgtatttctacattgtagcaacaaacagtctgaaaacaaaattaagaaagtagtcaatcaatagtaaatctagtctctgcattagcaggttcatttccaccagaggcaaatagaatccttggtgtctagacaagcccatagatgtgtatgtatttagggtgtttggtctcaacttcaaagatttcatattgcttttgtttcagaatatatattagtaagttttgagcactcatttctgaattttactgaaagtatctcgtttcacatattagctttttcaaaaagcagatacaaaagagttttgcattaaattattcctgctaagtgtatgagctggcacaacagcttggctgctgcttttatggtacaacagatgttggcatttcaaaataaacataaacttttttccctagaagtaaatttccttctttataaattagttctggacaagttagtataggcttgtatcttctagagagtttgtgatttattagttttataacaaaatggcttaaaagaaaaataattatagtaccatatgaaattcatacatcagctctttccttctctcatgggccatagttctaattattttttctaatggtaattgataaccaggtgaattcccttgccgttgcagctttatagaatttttttgctcttagctttcttgggaataatagaaaatctccaagttcaaatatatgtcagactgatgtgctccttctgtacatagataataactttattcagaagcctgttaaagatggctttcattttttatttcagatttgcatcagaaaggtaatgacagctcattagcccttgaagcatctaaaacttagaaaatatatttcacaattcaaggttaaatgggtcatcatcagttatgaaaggaagtatcatgcactctgtagaatgtttcacatatttcaaagtgttatctttacagggaaacacgtcaccattcttcttcagagaagcaacttgatgataggaagatctatcccatcttatcctttcatatatttatcaagatttggctatgtagacttttcctgagggaagtctcacactgactttagtagttgtctttggtactaaaacattagatgaaaaggattgtacagttataaattatcatgctttgtttgtgcttttggaacaatgctttttcatactgcaatatttgcatgtagagttttaattaagagataactgtctccacaggttggctgcagaaggctgcaatctccagcagggagataaatgccagtgccaagtcatacaggttgggtagcaaatgggggggtcgctaagataaaatgggcttgaaattaaaagcatgagagtcacttctttgtactttaatgaaaagtataaaatatttttgatgtattcatttatttttaaataattccctatttttaatgcgtttcaagagtatcctgaatgttgctgcctcagtaggatatttttaaaaaatttcagcatatggcttatttttctaagcaattattatttaactctcaaccaggaacgttatagtccatgacagtttttttccttgtttttccctgattcgttagagtcaagattctcttcccatgttcacaaacgaatttttcttacaagtgacctagatcaaacagaaaatagtctttattgactctagaaaaatcattcagaaaagagacttatatgacgttctaactcagattggctcttaagaactagtggctaggaatgtttcatacaggaagggaaaaaaatttaaacattttttattgatagagctgtacgtgtttttaagtacatgtgatattttgatgcatgtgtacaatgtgtaaatgatctaatcagggtaattgggatatccagcaccttaaacattaatttttttctttgtgttgggaacattataattcttctcttctagctattttggaatatacagtgaattattattaactatcatttccccattgtactatcaaatatagaacttaatcctcctgtctcactgtattttcatgtccatcaaccaaattatcttgatctttttctcccgctttcactttgcagccactggcaactgccattctcccctctacctccatgagatccacttttctcagtcccacgtatgaatgagaacatgaactatgtgtcttcctgtgcctggcttatttcatttcacacaatgacctccacctccatccatgttgttgcaaatgacaggatttcattcttatggctgagtaatattccactgtgtatatataccacgttttctttcttttttaaaaaatttatttgttttaaattttactttaagttctaggatacatgtgtagaacatgcaggttggttacataggttacgtaggtagacatctgccgtggtgtataccacattgtctttatccacttatctgttgatggacaattaggttaattccaaatcttggctctcgtgaataattctgtagtacacgtgggagtacagatatgtctgacatactgactcctcttggatatccagcagagggattgctggatcatatggtagttctatttttagttttttgaggaaccttcctactgttttccataacggctgcactactttacattcctaccaacagtgtgtgagcatttcccttccttcgcatcctcaccagaattttttgtttttttgtctttttggtataacagccattttcatgggtgagatggtctctttggggttttcatttgtattttcctgatgcttcatgatgttgagcatttttttatatacatgttggccatctgtctctcttgagaaatgtctgttcaggccgtttgtccatttttaaattgaataatttggcgggttttgttttttgtttttgtgtgtgtgtgtgtggttttgttgttgttgttgttgttgttgttgttttgctgttgagtaggcacatgttaagtaatgcttaattgagacctccacttccagtccagacacagttcatagaccaaagggagaatgctgttgccaccaaggctgtacttctgatcaagactcactgtttctcctttctgcttttaccctgtcaaccaattaattatgtctgctttgtcctcggttatgttagccaattataaccttttttggaacatgtaaggttcctttgtgcataatgtgatgggtaggggcaaccttccattccctgttctcatagtaaattagtgggtactgagaagagaagagaattgctgtattgtagtatgacatagcataatatagcataatataacatgacatgtcataacatcgtggaataatctaccttctccattaagtattaaaaattagagaaaatgttattccccaagaagaagctctgggcaatttgaagctgcttgtgttagtgacagtataggttctgatgtcttttattactgtttgtttcttggttgaagattttctacatatatatcacttacagcatacctggattggaaggggcaagatttgagtcaactccccttattttcctatttaaaaataattattatttcggagagacaaattgaataattgaagagaatagaaacaatacattttactttattactttcttttataatatcatataaagattctataggatatttactttcctcatatgtatcataacatactacaaaggaatataaccagtttagagggaagaattttccgtaggaaaaaaaagagctagaaatctgacatttcatgcagtccctttcatatcactccttcccattacctctgttattcgtcactttcctgtaacttggatgcagtcatcctctttttacgtttaaagtccagtctattagaagacaatagttgctgaagtttatttggaaaaaaggaagaacgtgctcacaacaggagagcaaaagtcaaattgtacaattaattattttgccaaatacttgaatgggttatcatttcaaattggtgacatgtcaaaaatcttgcattgagaaccactataccatcttttaattcattcagaatggtgggttaatatacctccacactgatgagctttttttttttttttttttttttttttgagtcagagtctctctctgtcacccaggccagagtgcagtggcatgaccacggttcactctatccaccacctcccaggctcaagcaatctttctcaagcctctcaagcagctgtggctacaggtgtgcaccaccatgcctggctattttattttatttttttgtagaggcagagttttgctatgttgccagagctgatctcaaactcctgggctcaagtgatcctcctgtctcggcctcccaaagtactgggattacagacttgaaccgtcacacccgacctgacaaacctcttttaaaaccaaactcatatttgtaaatccaaactcagagtcattgctttttaagacaagagggggccaggcacagtggctcatacctgtaatcctaaactttgggaggccaaagtggatggatcccttaccccctggagtttgagacatagtaaaactctgtctctacaaaaaaaaaaaaaaagaaaagaaaagaaaattaaactacctgggcctggtggcgcgcacctgtggtacggtcccagctacacaggaggctgaagtggaaggattgcttgaacccaagaagtggaagttgcagggagccaagatcacaccactgcactccagccttggcgacagagtgagaccctgtctcaacaacaacaacaaaaaagaccagagggaataaaatttcatgtgaggaaacaaagacccaggaggtgcacagtaattttcatagtcacagaggtgggccctagtgtccttgagtttagcatctgtacctgccgattccctgcctctgccttgagtaaggaacgaatttagtagtcaggaaatttatgaaagaattgcccatagggctgttccacaaagtggactccatagtctattaaaaatatgatcttaaaaattaaaaacaaaaacaagctatagcagctgctggttgcagacataaatttaatcctcacagccatgctgttggatgcatattatctccagttttacagattaggatccagagacttggagaggttagttaggtgattaacccaaagtcatacagtaatagttgccaaaacataaaattcagcctatctgacttcaaagaccaaacactttccatcacactatgctttctctcctttatacttttcaaaaaatccatttctgatgaagcaaagcacatgtatgtgacttacgaatgtaatgctgctatagagttgtccagaactgtgtgtatgtacacccgtccctctgacatctgccacgtttgggagttgtagtaaggaatttctgttgcccttcgagttctattgtccccatgtgtattgattgcctgcaggagtttagttgtcaaattacttgcctctttgtcagttaacagcattgtttgcttgagtggagtaccatactcaaaatgaagccagcaagatttccaaataaaggaaagacattctgataagtaatatggaaatattcaagcctcatgagaggacataatcaggaaaacactgaacaactcattactgatttagattattttctgcagtttccaatgcctgacacaggttttcctattgcattagcctctttctttctttccttttttgtttttgtttttttgagacagggtcgtgctctgtcgcccaggctggagtgcagtggtgcgatctcggcttactgcaagctctgcctcgcaggttcacgccgttctcctgcctcagcctccccagtagctgggattacaggcacgtgccaccacgcccggctgatttttttgtatttttagtagagacggggtttcacagtgttagccaggatgggctcgatctcctgacctcgtgatccacccacctcagcctcccaaagtgctgggattacaggcgtgagccaccgcgcccagctacatttgccgctttcttatgtatctcgtagaggcagtccctaactatcccatttcaagtgcaccgcccctctcactgtcctgttgtgattggtcgtcccctcagtagtgctgtacatagtctaatcgtatgacattccccttcttttttcactttccttttgccaaatcaaacacacgactctctcttcttcctttagtgggactctatacctgacatcgttgtcaggtatagacatgcactcaaagttaaaggaaattaaaatgggaaaagaaaatagtgggaaggaagaatattactttgtttagtgtctgcaaccctcactagaatgtaaactccatgaaggtcgagctgtaattgtgttttgttcacctctcaaacagagaacacatttgctgaatgaccgactgaataaatgaattgcactaatttactgtggagcctcaatagctgctcatttctcttaactattttacttgctaacggatttagcatggtagtacatctttattcattaacatagacaggtagctaccgttctcatgctggcttgttgaattgtgtgatgatagtcctgaatctatgtgatgatagtcttgaggctgtattcactactatatgtaatattattggttacttgtctctcttttaccttcttgaaactaattagccctttcgctcctttctgagttctttaatttttttttttctgagctcctaatatggaaatctgctggtatgtataatacatctgacaaatgaaatgtggataattatattgtttttctttagagatataatgagttgtctaaagtattagacttgaaagcaaatatttcaattaaagaagtcaaaagtagttaacaatcaaaggaggtaatacagtcaaataaaaagttaggcaacagcttcttaacatacatttgctatttgttgcctaccttatttcctccaattttgaaacatacttttgttttttaactttctgaaattgggatgtatttccaaaaagaaacttgcttgctgccaggtaagaggaataaattatgacgcggttgtcaccatggtgctatacctaattacagatgatcaagtcattcagaagaatcgttagactttaaatgaaggaaaggctcgtgattgtgttactaaaacaaaccaaaaaaaagggtatttaattatgtagattaaggggaactattatctgttggtttaaaaaaaaaaaaacctaatgatgtacctgtatgtatacattaacgtggcattttaccctgtgtaagatgtaattaaatggatgattaatgatgttacaattcatgatctcacagatagaagaaatatagtgatcgtgtgaatttggataggtcacttaacctttctaaacattgattttctcacctgtgtaaataaggagttaagtcaaagtttgttttttttggttgttgttgtttttgttttttttgtttttgagatggagtctcgctctgtcaccaggctggagtacagcggcacaatctcggctcactgcaacctctgcctccggggttcaagcagatcttctgcctcagcctcctgagtagctgggactacaggcacatgctgccacgcccggctaatttttgtatttttagtagagacgaagtttcaccatgttggccaggatggtctccatctcttgacctcgtgatctgctggcctcagcctcccaaagtgctgggattacaggcatgagccaccaggcccggtctaggccagagatttttaaaaatcctttccaaccctaatattcttgtgttcttatgttgaaaatgaatcttgaaaacttagcaagattttaaaagtttgtttttttattttttgagacagtctcactctgtcgccaaggctggagtgcagtgtcacgatcttggctctcggcaacctcctcctcctgggttcaagcaactctcctgcctcaccctcccgagtagctgagattatagacatgcaccaccacgtccagctaatttttgtatttttagtagagacagggtttcacagtgtcggccaggctgtaagttttaatcactacttaaaatcacattctctgtggcgcaggggtttctccagtgcctgctcctagaatcagtttagtagaggaagatatacaaatactgtattataaaacatttaatgaaattacagaattctgaagaaaaaataggctatttctctgatctatgtatgtgttttaggggaagagtgattcttttttatcagcaaagaccttaaaccaaaatctgagaacaaacaggagtctcatttattcatgcaaaaatgcttcttttattacaacagtttattacggtaaattatgcattaaacaaaccaattttgtattactatgaatcactcagtatggtgaatttggatcatttaaactgcagggttgtccagtcttttggcttccctgggccacattggaagaattgccttgagccgcacataagaggcactaacagtagtagcccataagttttaaaaaatagcaaaaatatctcataatgttttaagaaagtttatgaatctgtgttgggccacattcacagctgtcctgggttgcatgtggcctgcggcccagaggccacaggttggacaagctggatttaaaagattgtactttgattgtagaagttcagagttcgtatttactctgtaccttaagtacttaacgcatgatcgttctctgcttacctgtgtcaacgtttagctgcggtaacaaatttttgtgatttctatgcttgcgacaaactcactttggcttatgaacttgtcaatttctattcctatcattctgaagagatttccaagtagattatagttttcaatattttcatatagaaaggaagaacgtcttatatactgggctagtgccataattgaacctgaaaggagttgggagggagggcggagaacattaggaacgctggtgttctaaagaggaaccctaagatgaaccaaaatgtatcacttggtctgaaaagattatcactgtggcttattttgtgtcttatcgataaattatggtggactttcaagtataaaaagtgttcaacatcgatttttcattaactttcttatcacttaggagttccagggtataatagagataatcatctggaaagacaggccttttctctctgctttgcccccactaacttttagtgtttgtctagggttgtgaatccaggatgagtttttagcttccatttcattcttcttcctttcttctacgtagtataaattttttccactccaccccatttggttcaggggcctagatagtactaaaggcctaccataaccttctccctgtaataaccagggagcactcctttttcctatccatctattccttcattcatttgttcatttattccttgacatatgattttaacaaatatttgttcaacaccaatttatgggctaaggtgttccgtatataaatcccagttagccactgacaccaaagtcatggtttacagtgtagttacagagaaaagtcaacaattaccatacagtgtgataaatacagtaagtagacttgtgtacacgtgccaaatgatttaaattgggctctagtgaggagagaccaatattgttttaagcctttgctctatccttgccagtgggtttttatgtggtagctggtttgagtatatatgtaagcgaggtatcttgataccaagtagtaaaggaaaattactttttgaaataactgggaatttcagactggtctgtgagaatttgtttctgttttaaaattaaattgtagatgtggccaacatctcatccacaacttgttcacaaacatattcatctcatagtcagagacttgtttataaatttttttggaacatgaggaaaaaaatattaggcattgaaactcagaccgcaggctcatattttctttttgtcattggaattatctctaaattttatgcacgccacacattttcaacaggctgcctctccaaagtattgtgtttcgaaacactgcagattttagttgaactttgcctttccctgtttgtagtatttctattttacttatattgccctgttccagaaactactcctgaaagtagttcagaaggatacgtgaaacagaaggggaatgtacacattaaagctagaagcaagtaagtgctgcagcactctgtattgcttggtctcgagtagagttcctcgtcttagtactagcgacatttcgagcccacaggtatttattgtggggctgtgctgtgcgttttaggatgtttagcaccatctctgacctctacctactagatgctggtagcaccctcctagtcatgacaaccaaaaatgtctccagacgttttctaatgtccccgggggaaaaattgctcccagttgagaactgctagcctggagcatagttgcagagaaatggatctgttttggaggtagaattagtaggacttgtttatggattccctgtgaaggttgagaaaaaggaaagagctcgaagtgaatcttagatgtttggcttacatgcccagtggagtttggtgccatttactgaaatggggaagactgtgggaggacaggtgataaaggggactgggcaggtggaaatcaaatcgtttttgttgacttggacatagcaagtttaaatccaaaagagatgtcaaatgggcagctgttgagtctgttgctcaagggagagtattttaaagcagagtctggagagagtgtagatggaggagaaaagagtggtctcgaaaccaagctctgggagtggttggaggagaatggaccagtgaagaaggctgggtgagaagaaatcaaggagcctgtgctatcgtggaaatcaagaaaggaaagtgtgtcaaggaggagtattcacttttgttaaatacttccgagacattcaataagaaatgctaacactgttttgttataaataactgaaattaattttagctgtgaaaaaattaggtcctaaagtaaataaaaagatagtaatggggacataaaataggctgtgaaatgaatttaaaatgccaaaagttacaaatcccaaagacataacccttgctctggatgtgctacagatcttggctgtggacattctaaaagccattagaaagccttcagtcacttccagtattcacaatgaccataaagtaaaaggggtccccaagaccaccccaggctagatgatttgctgggaggactcacaggactcaatatgttagtcatactcacaagtaagatttactagagtgagaggaactacagcaaagtcagcaaaaggaaaagacatgtggggtgaagtctgcaggaaaccaggcacaagcttccaagacctctcctgtgtgtgtctgccacaggacagtccattcctgtggcagtgagttatgacagcatgtgtgaaatgtgttctgccagggaagctcgtaagagactccgtgggcaggtttttactgggactggtcatggaggcaccctctgcccggcatgtaccaaaatcccaggctcacagaaggaaagcggattcagcataaactgcactgtgtgcataaacagtttaaacatggtgagctgctctcattagtctgagaatggtgggaaccttccggaaatctgggttcccagacaccagccacggctagccttgcaagcaggccttttaaagccgtctcgggactgctatgtgaactctgttttttgtaaacaggccaaagcccaaggaaaatacaagcatagttggcactatgactacatcagaatttctctggaatgggcatttgtttaataaactgtttctaacatattctaaatcatttggatagctagtaagctaaaatttttgtctgtatgtattgggaggcagtctagcatataataaaataatcatagactgtgaaatttgacaaatatggcttctctagtcatggctcagctgcatactctctctgtacctccatttctggtaataaaacctaccattttgaagattcagtgatatatgcatatagtacctagaatagtgactgacacgtggtggccattcagaaatactggtggcattgatgttaataattgcaacaagagttgttttattattgtctttcttgtgttagacatgccattacttttcctggattaatcgattgtaatatccactctcctgtattttcactaaatggctttcagtttttcaattaaactttcagttgaacagtatcagaggcattttaataaaaaattttactgagcttgattagttgatgagaagtaaattgctcgtttttgattaccacattaactctttctggccattagggtaccatttagtaaattacttctctttttgtacagtactcaaaatgttacccaagtgaccagaaagagttaataatgcaccaacaggctgaacacttgactacctccttactattagatcagtctcattatattaaatgtttcccttcctataattgtcattttctttaaaaaatgaaatattggatacagttatttatttttaatagaccttataagctcaatgaaaagtatgctgagttcactcatataccttctaaggggatttaaagtatcggtactcactatataatatgcaaaatcaatccgatgtggataataaatgcacctttcacagtgcgcaagaagggcattatttcccaagggtacaagtgattccccgattatgatctgagtactaaggagtcatattattatgcctccctaagtgcttgagcactaaagagagttgtgcctcatggcattgtagcaggtaaactttcatgtgggcaggaatcctgccttttaaatgtatacattatcagtactcctgtggatgtgtttttatggctaattctaatacagcttttaattattcaggagtactctttactttcttatgaataggggtctgcaatctattcttaaaattacatcttttgctgggcacggtggctcatgcctgtagtcccaagcactttgagaggctgaggtgggaggattgctttagcccaggagtttaagactagccagagcaatattgagacccctgtctctacagaaaatttaaaaatcagccaggcatggtggtgcatgcctgtagtcccaactaatgtggaaggatcacttgagcccaggaagtcgaggctgcagtgagccgtgatcacaccactgcactcctgcctgggcaatagaggaagaccctatctcaaaaaaaaaaaaaaaaaaaatctctagtcaaatatttttccaggtcacctgggaaaattgttgttactctcttggaaagaatattcgactcctgaagtactagtttttgcaatataaaaggttgtctttcactttgggaggccaaggcaggtggatcacggggtcaggagttcgagaccagcctggccaagatagtgaaaccccgtctctacagaaaatacaaaaattagctgggtgtggtggcaggcatctgtaaacccatctacttgggaggctgaggcagagaattgcttgaatgtgggagggggaggttgcagtgagccaagatccactgcaccccagcctgggcgacagagcaagactccatctccaaaaaaaaaagattgtcttttcattgatatagtatagtccaataatccatgagccacttagtgtttactgagttgtcactgaatgtgtaacattaagtgctttcagtgatacaaaactaatatatgactggcttgctcattgattcagtagatgcttgcttagagagctatgtgctatgtactctaagaatacaaaacatcaaagaaattgaagtctgttgggggagatgattaatgatgacatcatagtacaataccattgcagctgtaaacatgcattcagaggaacatgcccagctacttcagcatgtcagagggagaaccgacccagaatggaaggagtcagggttatttacctccaagagatgaggctgagctcaatcttacaggataaataggagtcatctggctatttgtaccccagaggacaatataaagatacaaagttgagaaaaaagatgacgggcagagggctagtgctataatagtctcttgttgtttatttcatgtgcaaagcagaaagcaaggctgagtaagtagagagacatcaggttagggatatgccatggtttaaatttgctgagttttttgtaacctaattagaaaaaggagagtaatgtgtgtgtacacagtggagacagtaaacacatggtcactggagttcattattttatacattcttccccagaatccatatggggcatagtattatttttcctgttttatatataagagcttgtttcttcgaaatattaagcaaattgcctaaggattcagagaagataagcgatggagatagaattcacttctacagaattccaaaatccaaacttgcagagatattgaacaacttgcccaggattatacagtgagtaagcacttaaaaacgtggatttggaaagtgggatcagattatgttttctggttataactggattaattgaaaatgaggacgatcactgatttcacagtgctttattcttagagatgtgccagattacaaaatggatcttttttcctcttatactatgtagcaccttgtccaagcaagctgaaacttggtggatggtttttgttttataacatactttcttggatgattaagagtcaggattgctgtggtactgacttgcaccctcctcctcaaattagcccagtgcagagatgtagccttttaatacatacaggtggaaaggtagcgtggattataataagaaaacaacaaccaagctgtacattttccttagatgattagatctgcctcaggaaatcctgcagagtttcaaatagaaatgtgttcatctttcctatggaaaataaattctcagtgagactgcttacttattttcaaactctgaccctcacgtacatattttggtcaattttgatacttgttctgaaattcttgttggtatttctattgaaaaaatgaactattgtgattattgtattcttctcatagactctgaggcaaggcagaatactgcttaggccaggatttgggcagagagggagtctttttttcataaagaatttttattgtggctgggagtggtggctcatgcctgtcatcccagtgatttgcgaagatgaggtggaaggatcacttgagcccaggagttgaagaccatcctgggcaacatagtgagacccccatctctacaaaaataaaaactaaaaaattagccaggtgtggtggcatgcacctgccgtcctactactccagagactgaggtaggagggttacttgagcccaggagttcgaggctgaagtgagctatgatcgcgccactgcactccaccctgggtgacaaagtgagaccctatgtcaaaaaaaaaaaaaacacagaatttttttgtaatggcatttaatctgtaatgaattatgataaacattattacattattatatgttaataatacctacctctcaggattagtgtgagaattaaatgagtaaatatatgttaacatatgtgaaatgtttagaacagttactggcacacaataacctctatacaagtatttgttattattacacattttttattttattttatatttagattatctattttaatattgtatatgtattggccttacaacaatgaagaattccgtccaatatgtaggaaactccaaatgggaattgagataaatgccacgaacaaatatggtgtatttttatttactttaaatttgcacagattaactagattgttgtttctgctgttagtagtaatatttttattttctgtttatagcaagtctttcttcttcatagatcaagtttgtaacttgcaattatgttggggcaaccagtgtcaactggcactgtccagagaaaatccgttgagatttgtaagccattcttataaaattaacatgcaaatagcctctcaagtctttcttctatcagtgtggccatgttctagcagtaggactgaagaccattgaataggaatgttacaactaatgcctctactgggcgccggagcaaaatagctgccaataggcatgccatgctttttagcttcagtgaaattccagttagaaatcttgagaggtttcttagtggctgatggcagctcacaagtgggtcagaggatcacatcctggccgccgcaaaaagtacacacttttttttctttccttctgccaagaccaaaatcactgacttgctggaaagaaataagcagatgtgactgctgctcatcttcaggccagcctcctatgttttcctgctttgatggcttggcggaacgctgggcacatataaatattttatattggtttaggcttcattcctcagcatggagcctgtttctgctagctcatggtgaacgtttctgtgaagtcactccttcttaccccatatccatgaaaatctcatctgttgcctctcctggtgtcagaaagctgaagtttaattcatgtaatattagatatttcatttgtttgtcagatggaatgtttattaaatagttttttactctatgtcaggggttcttttttttcccttgtttgctttttatgcattcaatgattattcactaaaagcctgacagctggcaagatatcgatacactaggtactttgaaggagtgtccagaagaatgaaagacataaatacagttaactgtgtgtttcagttagggaaaaataaggatttcaaggaagtacagtgtgaatgaagtgttaggagctctgataatatctgccatttctctgctctagaatatcttgtctgatttcttatctttctcctgtttcatcctttttgcattctctcgtcatcctgtggaactcttacataaatcagtgtcattggtggtttcttgactcagttttcaaaaaggctagctcctgcagtcatttcatcatgaactacagtctgtaattgcaggatctaaactcttggtttataaatatcattgccgtctctttctcttctatgtaagatctctctcttgtctagttcaatcttctaattacgtacttcgaggtcttttaccaattgtttgcaccagctactttatctttctgtttcgtgctccattactccctaaaccaaattctcagcttcagtcaagtaaactatttatttaccattcccggagcaggcactttgctttctgctatttcttggcctctatacttgcaaatgcttaacatttgcatgtagaatgctctccttccttctcaccatgaaaacgtcttctgccctttttcaaaagttttctatgacaccgtctgcataatctcattgcctctagtaattctacattttccacatgtgtttaattatttagccatgactagttacttgacgttaattttctatcaggtttctgtggatacgtttgtgtccctgtctctgtgttttgttcatgctgcagcgtgttaagtttccaggtaccccatacagtgttctgtgaatgtgcacagatgcaaactgaaatatatttatatgaccatggaagatgattgattcatcttgctgctcactgactgctattttggagagtgcattgtttgtaatcttcccagtgatttaactgtttttattaagtgagggctttaaagcacttaccatttgcttttggctgttctttttgaacaggagtaaaaatgctcatagtgcttggcaattgaatgcttaaatatatacattaattagtctaatataagcttttagatagtgttttttatgttcacgttttgggcaagtattcaggcatccgcacgtctcttctgtttaccaaaggtgtacccaggaagagtttgaagaaacaatgttattaacaattatttatggagttcccagaggcacaaggcatttggctaaatgcttagaatacaatagtaggcaaattcagaaaagggagtttacaagctaacaaggcatattaatgaaatgatcacacaaataaatgtcaagtcaccactcaggtcactcagggaactggtacttaagcagagatttgaagggtgaggacatacctggggacggaggaaggagagaaagaagaaaatacaggtaaagggtagagcatatgcagaagtagcaggtgggagcctgacatgtttgaggaattggaagtagatgattgttgctggaacacagagcaaagcagcataatgcaaggtgagctttgtttaaggacttggatctttggccagaaagcagtaaacagtgctgggggttagaaggatgtgaccagattgctattttgcattattaccttggttacaatatagagcaaattggagactgcagggaggtggtagtggagttgaagagaagtgggtgggtgttggaagatatttagagaatactaatatagtatggatgtaaaagcaaaggaaaaggaggtttccaagatgacagctacatttatgatttgcaggaaaggatggctggtggtaccattttctgaaagggggtatgctaaaatagaacaaggtttgggggctgaggaaagatccttagttctgttgtgaacattctgaagttgagacattttgcagcattcaagtggagatgtcaagccactagatctgtggctgagtagctcaagggaaatgtcaaagctatggatatcggtgttataaagtgatcattatatagatgataactgacactgtgcgtatagatgagattgcttaagaaaaaaagcatagattgggaagagaggcctgagtgattctgtatttcagtggcttagtaaagggacaagaggctacaaaatagactgagaaggtacaagcagaagggcatggaggaagtgctgagagatgaagagtgcagagtccctgcaggcaagagaagagaccatttgaagagggacctaatcagtggtgtagaaaaccatcaaacatcaagaaagatgaaaaataaaaatgctctgcttgattcatttacgtggagaatactgatgagctagcagtgacttctccggagggatgggagtggaagccagagtggatgaaggagtgagcaaggagatggagacagtgggaacagagaactcctccaagaagttcggctatgaataggaatgagaggaataacatggtatctgtatgttcagggaatattttaatgtttttaaaattatagagaattatgagtgctcaagtgctattcagatgtagaaggaagatattggatgtgtaaaccaggtttgtgatcatcaacaaaccataaggatcattcgaacgatattaaattttcgtacagcattaaaatttctcctctaagcacaactattaacttcattccttcattcagcaaatagttattttaacactttctatgtgtcatgcactgttctaggttctgggaatataaatgtgtataatatttactgagatggagaagattcggtgtgggtgaggttgaatttgggggaaaatcaagaagtttgttttggccatgttaagtttgagctgtcttccagacacccacgtggagatgtcagatagactgctggagaagctgactgtagagtgtggcagatgtgaggacagggaccttagtgtccttattgctgtatccccagcgtctggaacacagacataatttgacttgagcactcttcctaatactcctagagaacctaattgatacaaagtttactgtgggacacaataaagaatagaaaacggtaaatctaagattgacaagaaagtttgatttgaatgtaaacctttgtaaccttagccctacttgtagcttttgttcattttaccttcaggcctctagcatttcctccataagttattatgaagccatggtggagggaggaagagggactaaaattcaagatgttgtatagaaaaacaagaaattgctaacagagtattcgtttccaccagataaaaatttcacttaaggccaggcacagtggctcacacctgtaatcccaacactttgggaggccgaggcgggcggatcacctgaggtcaggagtttgagaccagcctgaccaacatggagaaaccccgtctctactaaaaatacaaaattagccgggcatggtggcgcatgcctgtaaccccagctacgggaggcggaggcaggagaatcacttgaacccaggaggcggaggttacggtgagccgagatcacgccattgcactccaacctggagaagagtgaaactccatttcaaaaaaaaaaaatttttcacttaaaaaatatttatccagtgaacccgtgtgtctcaccaaggattgagaaaacaggctgacagaatggtgtcagcggtgttgagtaagcacctacttcatgtcaagaactgggctaggaattgagatagctcggtgaaaaaaatagatgcatatacatatatggcttctgctctcatagaacttagtaattttgcaaagggcaatgaagaggaactgcatatgctaacagagctcctaacgaaggaactaacctagttaggaggatcagggaggatttccctgaggaatcagtgttttgctcacatgtgaaacatacatagatcatttcaggcagagcgagcgagtggtactaaggttagtatttactgagcattcactctgtgcctggcacagttttaaacactttcattatattactaaggtagattctatcactaatcccattttacagatgggaaaactaaaaccgctaagagtttaaaaaacttgctcaacttcaaacagttggtaaatggttcccagaattctagctcaggaagtctgatttcacagcacaaattcttacctctattttggttttttaaaagcatggtgtttttgaaaaactgaggaacatctaacatgacttaacagagcaatatcatgtgctatcttatgggtttgcaattttggactttatcctaagccatagaaagtgattctgtgtgtgtgtgtatagaaacgaaatatttttggacttccttcatttccttaaagcctcaaaatagagagcagaatgttaagaaatctgtcatttgtgcacatgagcatctttcaaaaacacaatcatccaacaatatactgaattgattgtcttaaaattatagggtggtgcaaacattttcaatcatgccattggtcaagggaaaaaagttagatgagaacttctattgaatccatgctattttataggaattttgctagtggcttaacatgcattatcttatgtagtatatgtaacgaagagtaagctgtgttttcataccagaactcattactagcaattcagcacttaatatgatggagaagattagaaaacagattttaaatgctaaaagccaacaagctcaatagcaaaatctggttttaagtaacatttaataagctatcatttaataaaatagtaacaacaggccaggcacagtggctcatggctgtaatcccagcatgttgggaggctgaagtaggaggattgcttgaggccaggagttcaagaccagcctgagtaacatagcaagaccccgtctctacaaaacttaaaaaaaaaaattagcgaggcgtagtggcgcacacctgtagtcccagctacttggaaggccaaggtgggaggatcgcttgagcccaggagtttgaggcctcagtgagctatgatcatgccactgcattccagcctgggcgacacagactctgtctctcaaaaaaaaagaaaaagtagtgacagccatatatagcagttttcatttattgagcacctacttagtttgaaggttatgataccaaagccagaaccaagtattttatagcaaagtctctcccccttgtttgtaaattgagtgcttattttgtgcctcacatcatgccagcatcttcagtttttggctctgaggtcatgttcattggaactgtgtctgtggaaatgccttgagttctggctctaggggaactctttagcagacgattttcctttgtttctgccaagtacctgaggcacagcttacctgggacacttttttcctctgcttgaggttttcagacacaggtaatgtaaattcaatgggcaaacccatttgagggctacctcttggatacaaattcttgaaggagatgtttttctttctccacctagagccaaggtcaaggcaggcaggtttctttgtgtcactttatatagggtagttttgttatagtttccctatactgagagcacaattctttgggagccttgctttatggaagggtttttattaaactctctactttcaaagggacaagccctgggctttatcttcaccccagcgttccgtgtactctttcatgatgaagctcgaggtcaagtttcggattcaccttgtttttggcctcttagtatactttactttcttacaaagtcagtgagatgagtaaaaatgattctatacaattttttatcctttatttaatgttagcaggagagttgttcaggtgtctactttccatatcactgtaaatgaaagtttaagcttttaactatgcattaagctgttgaatcctcacaacaattctcgtggtagatgtgaagaacacacgggttaaagaggtttgtatgactcagctaagatcatacagccagtaaaaatttgaaaaggagtttgaacccaagccgtctaactttggaagctatagcaaatgttggtgacataacaaaggagttcctaacgaatgtagcttgtgattgacctatatctttcctactagaaggaacaaacacaccagtaatgactcgatggatgcatggatgcaaggatggagggatgcatggatggatgcatggatgcaaggatggagggatgcatggatggatgcaaggatggagggatgcatggatgcatggatggagggaagggagggaggaagggaagtgtctcaacatagagaccaggagaagaaatggcactacagagtgtatttatttgaacaaattcaataggagaaagaagaaaggttctatgtcaggaggttcatgcaattattctgctgcatctggtagggtcattgcttctatttggaggttacatgtatcttcagaaagtttagctgtattaccagttgttggtgtatgctgatttttatgagtgaagtaatataataagaatgggcgagcacaaggagaccagcattctgcttttaataacctctaaccttaaacaggttactgaggcctcatctaggcatctgttcccttatctttaaaaacaaaagttctttaaagtctcatcttttttttcaccaaaaaacttaaaaaattgagatagaacatattttcatatatatatatgtgtgtgtatatatgtaagttgttgatacatgcttttttggtggtattccatctatagaaaggataattttccagaaaagtatattttttttttagtttgtgtcagctactctattttaagtgctttacatactgtcgctataggatagtcggatatgaatctttataaaagtaattttattagggcttattttattctttggaataccaattcagatgatatcatcaatataatccttttggattaaatagacgaaggaggttgccttttatttttatatttaagaaccagaatattgtgtagtaccttttgcttcaagatgttcaggtgagaatgtttcaaaaaactaaaataaagggaaagataacacactgtcagttttcctctcaatgtttcctgacaaataagtgagttatcagatttcagtttatagttcaataagtttatataactaataacaaatattgtattcagaaaggtatatacatgtaagtttttagttgattgtgcagaaagagagcagtactctgccctaccctattctgtgttttctcgcctttccaatttctacttgcctttcaagttccagctcaactttcccctgcaaggcattttcctagctccctccagcacagcattgtggattttttttttttttttttttttttttgagactgagttttgctctgtcactaggctagagtgcagtggtgtgatcttggctcactgcaacctctgcctcccgggttcaagcgactctcctacctcagtctctcgagtagccgggattacaggggcccaccaccatgcctggctaatttttatatttttagtagagacagagtttcaccatgttggccaggctggtcttgaactcctgacctcaggtgaggattacaggtgggagccaccgcgcccggcctgcattgtggatttttaaataggtaacctctcagtctccttagctctcatgactatcaaataaaagttgtgttgctcatcttctccttacctcctcaccttttaaacccaggaattaatggaaagaaggagacattcatttaaggagagaacctatgcgttggcttgatgaatgatgactgtgtgaaagttagggacttggagtcaaatatatgcccacactgttaaagacagtatcatttacttaacacataactagtcttcatctaggtgaatttgagcaaatctcttaacacctcctggcatcaattttcttacctgaacaagagttagggtagatcaggaaccatcaatcagcgcatcaaaatcttcaacagtagatattgaaaacgtacatgctggatctcatttaaataaattccccttggggatttacttttattccccatctctgcagagattaaaaagtaaaggaaaattgcttctcctgatagaaaaaaaagtcgtagtttttagtcaaggtgatttctaagatgccatctagttctacaattacagagctatgagtctatcacgtgagtaaaataaaattgaggggaaaaaagttaagacaacataccagtgtatttacttgatatgtctgtttgcgtggaaagacgtcttttttgtttgtaagaactcattaatagatgtatatttttggataggtgatatatcagcaaactgttgttagcatctctatattatatcttaaatatttccacttgccttcagccccactacaaccacccaggtctaagccactctccattacctcttgcctggacctctacagttgcctcctgcttggtttctagcagccagaatattttttaaataaaagctgaatctcagttctctcttgcgcagaacctctcctggcctactagaccctgaataacttggccttcgcctttcgttccagtctcatcttgttctgccttttcctctgcccttgggccttctcctgttttggaacgtgccacagtctccctccccggtggtattacacagtcagttccctcttccagaagactctgcccctgtcaactggtatggcttctctttctttgtctttagatctcagcttaatatagctccacagaaaaaccttccctcactgccctatttaggtagcccacctgttttactctgtttctctgtcctgtttgcatcttttcataggaattacagttgaccgttgaacaattagggggctagaggtgctaccccatctacacagtcaaaattcctcatgtaacatttgactcctccaaaacttaaccatgaatagcctactattgaccagaagccttaccgatcaacagtcgattaacacatatttggcatgttgtatgtattttttactgtattcttacaataaaggaaactagagaagggacaatgttattaagacaatcataaggaagagaaaatattcttactgttcattaagtggaagtgggtcatcacaaaggtcttcatccttgtcatcttcacgctgagcaggctaacaaggagagggaacaggaagggttggtcgtgctgtcccagaggtggcacaggaggaaggaaatctgcatgtaagtgcgcctgcacagttcaaacccctgttgttgaaggaccagctgtattattactttgttatttgtttccttttaatttttctttctagaaaaattgacagcaggggccatgtctgtttggtttaatgctgtaacattccaagcacacagcaagtaagtgctctacaaatatttgttgaatccttgactcaattagacatttaccatttttttttgttgtttgttttttttagagtcagggacttgctttatccagactggagtttgtggcacaattatggctcactgaagcctcaacctcatgggctcgagcaatccttctgccttggcctcccaaagtgctgggagtacaggcatgagccactgtgcctggctgacatttatctttttatctgtattttacttcagttaattaaaataagttttattctctgaaaaccgacaatcttttattctccaagcaactgaaaatagtctggaaatgtgcaaagaaatagggaatcctaccagagatttaatctgtccacagataatcctgaaaatggacaagttgcttatggataatcaaaagtgtgtccaagagttaatctgttttttgaaaaggttctatatatgccttgctgtagttagcagaggtcgcttcaaaagctgttcatattggaatctgtgtatacctgagtgtgtatgatgaaaagtctttaattgtaggtttgcaacatgtttgtagaatctgatcagtatgttaactgctggattaatcctgttttctaaatcttcaatatgcatatttttacaaaagaaatatctcctcttccatttctagatgtacctcacgtgattaattctcatgagtaagcagagatcttgacctgtagcttcttacatctgcctatttgtttagcagaacagagaattacggtaaaacagaggcatggtacaagcgtttgtgtttgctttacaaacacgtctcccaacttagtacaaaaaaacactgcaaactcttaattttagatcttcttaggtttgttgtaaatagaaagtagagtataatgttttatagatttatttctaaactatattatggttacttttctcgtgcttttcagatatttgagaaattgtttatgtgctgtcatgaatatgaattcattattattaaatgttaatgaataattttgcttcaaaataaaatagtgagcctgtatactttcacttgtatagtgtcctagcccatattttaattttttagtttttccctttgttttctttcatgtcagcttcttcatctggtccatcagttattgaacatattacgtcacctccgccccatcccatcttcatgacaatcagaggaggttgctaagtgctagtttcatccaggccattttgtggccaaacgctaagcacactaccagttctatccaatgctcactcactggtgcagtttccatttgagtccagccctatagaaagaagatgacagctttcggttttcatagtttgactaaactatctttttgtgtcatgtaaggaaccaaaatcatattttaaacttgctccttgatagctccttatttaaaattttctgggaatgttttatcactacagatattaaggcatggagaagaaataaatgctttattgtagccacagaaattgttttctttttctaacccaatcatttgccatctctctgaaaaaaaattccaaggccaggcacgatggctcgtgcctcgagtcccagcactttgggaggtcaaggtgggaggatcagttaagcccggtagtttgagaccagcctggacaacaaagtgagaccccatctctacaaaaataaaatataaaaaaattagccacgcatggtagtgtacacctgtagtcccagctacttgggaggctcaggtggaaaagatcctgtgagcccaggaggtggagggtgcagtgatctatgatcataccactgtgctccagcctgggcaacacagtgagaccctgtctcagaaaataaaatattcccttctcatctctgatcagaatagaaaaagaccgcccgtgactcatgtttagaatttttgcaatccaaacccagcttttccacattttatgaaaatatgagctgccttgagttgcacaatgttcacagtaaacacacggttttaggaacttgaagaacgtccatacatagaacccagactcttaactccaacacagatcactaaagctttggactgaaaagcaaggagtgcacaggccgaggcaactctacctgggggaggaacacttccatgaccccaaggccgggtgagcctgttggttctggcattcattggttagtcacctgatgtagatgttctactccagaggtggcaagcgtgtgggacatttgttaacactcccacctccaatacttacaacagacatcaataatggatcaccacttctcagccttttggctaagatcaagtgtagtgtctgttcttaccggtttaataatggatcattgcagtgtttcctactgagtgcaaagacagtcttgggatctgtcttaacacagcagtcactttcaattgccaaccttgttttaaaaaagaagcatcagcactccctgaaatccctctccgtttttcttactctattcttatgctatgcatcccctcttcccacccttccccatcccctaccatggcaactagactcttatttttatgattgctttatgatattttctacagaacctgtcatttacttttaccaaatggaaaacagagatgatgtggtttttttctctcttacttggcagcccagcaataacttaactaagtgagcagtagcctttttaaggtaagatagaattttaaagtcggctccagatataattctaatgtgtccggtgacactgcagaaaatgtaaatttccctggaaccatgtattattctgggatgtgtgcatgtgtgcatgcttgtgtgcatgctggtagatgttacggtcaagtaaaatgtcagcacagtaattatagaccaaaaaagttcacttcaaagaattaatactgttcaaaggaaaattcacgatttggaaactcacaaatgtaaaactaaagcattttcttttcgttcctttccattaaaagttgagaggagtagttaccactctaggatgaagtctataatagcataaaaatccctctggataggaaagagtgtgttgtttgagttttccagcccatctgatcggatttcagaactctttaagcgcttagcttttggtgtttttgggattaggaatgtgtgttcttgtagagagttggaaagcaaatgttaggcttgtcagcatctgaggaccgcagaagcagtccacccattgttcgagtcacgcttccagggcccagcacttttcactgaggagcctgcttttgaagtgttttctttgcttaattttctccacctttgagatcctttcagaagtattttctttcaaaatatcatgcattcttctttagaagaattggcctttctaataatacaaagaaacataggatacttgtaatctgtcaagtagggctaaaaacattagggcattaaggacagatagaataagggttgtggaagaagttttgcagtcgcattataaattgacttttttccctttttaatttagtctgactatagagaactatatctaggcaagaaaataagaaatgttgggttcatttagaaattgcaattggttttttcatacgtaatgggaaatcaaaatggaaatgctttggcattacaattatgtattggagtcttacttgtgtatgaaaataattgaaggtctaataaaaattccgctcaaaaccagtgtctgttattttatggagttacattttaaacattaaccaagatgaccataaaattatgtggaaagtttacgtttaaaaaaagtcagcataaaatgttaacatgggtttgagaacagaaaatagcaattcctaaaatagctcttgtagtcatatgtatgtatgtatgtacgttgatttacaaatttaaatacagaatttaagaattagaatatactttgattcacaaaataaatgaaaagtagctattcttacagacctatttgttgagatgtaatccacagaataattacatatattggttcactgtatatctctctgtttactaagacttaacactagggtcacagatcctgaagtcactcctgttgtttttctcaactgctctaataaatctgtgacctttctctcaggtggtagcatcctttgcagatgttaatttcaacatctggtggactcattcttaattttgttctgtgaaaccttattctgactttaattcttagcctctgaagcttgcttaaaatatttctttttgggttttctgggtgttcatcactagagacaagttattaatgcttctaacaccagggatttgtggaggatcttctatcactgtaaatctgtgctcccttaaagtgaactatatgaggttaaaatagaagatgtctatttttttttaacctcaatacttaatatagtgcttaacacagagcagttactaaatgtttgttgaatgaaaacatatcctgaggcgttgggattgggaaggaaagatgttattttcaacttctaccaaaggggctaagcagtgctttagggagtaaaccagttgggagatgatttagtttctgtcacaaaaaaaatccttggctgggagcagtggctcacgcctgtaatcccagcactttgggaggccaagatgggtggatcacttaaggtcaggagtttgagaccagcctggtcaacacagtgaaacactgtctctactaaaaaatacaaaaattagctgggcatggtggtgcctgcctgtaatcctagctactcaggagactgaggcaggaggatcgcttgaacccgggaggtggaggttgcagtgagctgagatcactccactgactccagcctgggcgacagagtgagactccatctaaaaaaaaaaaaaaaaaaaaaccttatatgtataattgtcccttcatttgtccataataacacgaagatgatgaaattgtccctttttcccagagctctcagctaaaattttctgactttgatttttaggtccatacctaatgttagtccatgttaataaacagttttcaaagaaatataacagcagcggtggtaggataactatgtaaactatgtgaagaaataaatacatggtcaattacgtgaatttgcatgaagaaataacttttcaaactgtgatgattagaaaaggactgaataaagtgcaatgaatctattataaattgtacaaaagagagagataataatataggaataaaattaaaattataaatataatttcataagaggcaaccaagccatcattactatttcatctgacttaatatgaccccctgttcattatgcagaccagtggaatttgataattgtgtagtggtattctaaagttgcatcttttactgtatttaaagttaaatgggccatgcacagtagctcacacctgtaatccctgcacttcaggaggccaggctgggaagatcgcttgaggccaggagtttgagaccacccttggcagcatagtgagacccccatccctacaaaaaataactagccaggcgtggtagtgcatgcctgtaagtcctagctactcaggaggctgaggcaggaggattgcttgagcctgggaggttgaggctgcagtgagctgtgattgcatcatgacaccactgcactccagccggggtgacagagcaagaccctgtctcaaaaaaaaaaaaaaaaagttaaatgatatgtaacatttgggagtgacaagactgttcatcagcttggggcctggcagcaacttttctagagttagcttttttctcctttcttgttccatgacttaaaaataataacttgctgggcatggtgcctcattcttgtaatcccagcactttgggaggctgaggcacttgtggccaggagttcaagactagcctgggcaacgtagtagatgccctccccgccaccatctctacaaaagaaaaaaagttaactcttgatttgctttctagtagtgggtgaatttggagttccaatgattgtcaacccattaattcttcatttactgaacatctccttatgtttcagatgctgcaaagatgtacaagactttgtttcctaccctccaggatatttcagtcttactctgtgatacttaaactattttattttgcattagttgaacctttatctgaattcagttttgctgtaccattctgaaacttgaagagtgttctgagagctaccaagctaattaaaggattagaaaatgagactcatgaaaagaactcaagaagaattgaattatttaacagaaaggagagaaagctaaagggagatacattaatcatttttgaagatgtaatggatgatgaccatctagttctagcattggccaaagatgggaaaggaagaagtggattaaattatagaatgagatagtaaggttagacttgagagtctaagaacacaggagttattttaatatgagtcctcttaatgaatgtagtcctgacatttttaaagggtatttttaagttacataaagtattttttgttttcccaagttaaactgtgactgaatttagggattaacagaaaaagagtgttcaagtttttgtatcatctttcagaaaattatagagcttgactagggagcgagccaacacttggttccgggacatgcatgatactgaatcagtaaaaagcaaatggtcacagcaagggcagccctctcgtaaatatatcgtaatttgcttttgtaatctttaaatagtttttttgttctacttttttagacagggtctcactgtgttgcccaggccgtggtgcaagggctattcacaggtgtgatcgtgcacactgcagcctcgagcatctgggctgaaggcttcctcttgcctcagcctgcagagtagctgggactacaggcaagagccaccacgcccagcagtgcttctatagtcttcataaatcgtttagaaaattgaaatgttctcactcataggtgggaattgaacaatgagaacacatggacacaggaagggggacatcacacactggagcctgtcgtggggtggggggagggggagggatagcattaggagatatacctaatgctacatgacgagttaatgggtgcagcacaccaacatggcacatgtatacatatgtaacaaatctgcacgttgtgcacatgtaccctagaacttaaagtataataataataaaatttaaaaaaaaaaagaaaattgaaactcatttactagagataaacttaagagcataatgaaagtttatttttaaagagtttcctattcctttgctcggttgcatattgctagggacgatgtctactaagagttaatgcctcctctcatttagatttgaaaggcattcttgccgttagcgtttacagcactttttcagaccacaacagcttgataactcgggttactatctaaaccttcaaagaaaatggagagttagagtccatctgcgttgtgatttaacttttcaaagcctctgatttttaagccctttcacttcaggtgccaaattttctcaaagcacaagaccccttaactcaatcttttctctctgccaaatgaacaattttatgtctcttcccttactctacagccactgaaatctagtattcagtaatatacttaggaaggtatctcagtttttttcttcatgaaaaccttctgtgctgtattacttgtggccaatctcagacgcaagtgtaagtacgtacatagaacctgacaaaaatttattccttagctaaaaagggataataattgcttctcctcatgcttagaaacattttaaatataacaaaggctttctgatgaccagctgagttttatctcttcttcatccttcatctgattaatcttttctttcgtgtttttatttctcagttgcaatgccaaagctctatttgtactgttcttctaatagaggaaaaatgcatgcttgcccagtttaaatattccaacttttgccgagtgataattaactgacctcatcccatctgaccactgacttgcgaaaatcaagttttatagtgtgattgaacaattagttgaactacattatccttgtaattcatattttaccaagaattacagttttctacatgatagtaatgtaaatgcatcaggaaaagagggaaatgaaactaacttttattgggtgcctactttgagcaagcctgtgtgccaggcaatttgtgtgtgtgtgtgcacgtatgtgtgtgtgtgtgatatttaatttaatgttcatagtcttgaggctttcttatcattaaccttgttttacagatgaaaaatatgtagcatggagaggttaaataatttgcccaagattttaggtttattaagtggcagttcaaatgctcatttacttaaaagtcatagagaaaaaaaataatcaaaagaattctgaaacaaagcccatgtcaccagaatcaagagtacttggaagagaggggtcagtgtctaatttgtcttttcgcagctttaattttctatttctacttctgtccgtttccttttaagctttttttttttttcctttcacatgatgtacgtttctctaaagccagagtagtgagcagcttgaaaggttaaggaaaagaggaggtagggaggcggaactattgtggtctctttatttgtcatgcctcaagcatacgatgtagtaatattccttgtcttccaaaaaaagaaatcagtgaacgtggttccttacttagctcgcattaatggccatgtgagtgcatgctgaaaatgtatatttaggaaagtaaggacataattaacataaaaaccattctaatagaattagtctatgactgaaggaggcaagcgagtccaaatcattctgtattgttcagtacatttttttttaatatcaggcataaatttaactgtgtgttgccaccagtgacaactatcatagaggtttgggttttttaaaatcaagaaatatagtttgaatcttgctcctccatgaactgtaatactatgtaagtcttacttaaaatattatgcttatatggtagacattatgttagtataattgtgaaaaaaaatagttgcctagaagtagcagtggatgctttaaaattttttttcaatatatttaaacaaaaagattatttgtatggtttggggcttaaacattgatttgggacctaaagtacatttaaaactacagcattggtgatgaaattttggcctggttcaagtaggtgctcagtaagtgagcactgaatgaatgtgctattaactaaacagccttacaaataaataccatgtcaagaaagactcagtacatcaagaaaaccaagtgcacatattaacttaaatgcatttatatgggttttaaattgttgcccttcaaaatgcaataatgtatttattgatcttgattttatgatttgtaaaatatgcttttttaaatttcctgaaaattaaaaacttaagtcattaatccactactctctggaattactttttttttttctacgaacacttaagagtttctctaaaagaataacttcccaggtcctgaggcctctggaattactttttttattctacaaacactgaagagtttctctaaaagaataacttcccaggtcctaatgcttaatgcaggaagtaatattagtactttttttgttgtttagtctctttctctgaccaaatatgccaccaacttgagtctcattgtccctagcccattaggaacaatagaagttttaccccacttcccagcccttttcttaggaatgtaggaatctggctagaaggcacaacaacctcccaccttcctagtagaccaaggattcctgttgtcagatgcagtgggcatgaaagcagcaattttacagcacaaaaactccaataacatttacttcggttggctgagattgcaatgcacacaggcactgctcattcttggttgcttaagcaccagctagcttcccttggctttttgccactttgtgcatttcagagacaagtcctttcaggagaaagcattttgcttgtaacttgcagtggagtaaacagaccattcaggcatagtttattgcattacaaactcaactatgcgaactatcccaaaattgaatacaacaaagtaattagtgaaatcatttggtcatgagaattcataaagaggaattgtcctatttaaaaaataaaatttttcttttctaaagaattatttaaaactttatatttagagaatggtagcttatctcttataagttttacttacatagtgaagcttaaagtgaccaatttacaagtgtcttccccttcccactcccctgtagccagcactttgttgaattcatttgggaaatcttaagagggcacccacgttgcattataaagcaaacactgaaatgacgatgacccactcctacgtagactgaagtgctggcatatcaaccccatgttactatataaagaataggcagagaaaagcatacaaaaacatctcaatagcctgactcaggctgaactaggtaaaatgtgcatacacattgtggattccctagaagacaggcaagggaaggcaagagggatgtgcattaggttaccctagaggcagtattcatctaatcaagagttcattcattcctgcagccagtttttaaaatcatacatctaatgtgtactgaaaaccagttgctaaatatggttaccagacattttcttcttctacaagattgtcctaggttctgtatttgtttttttgtggagcttttttcggagaactttaaaacaaaattataaaatctcatgtaaaatcaaaattaaatgactttttctattcaacattgtatctaattattacctgtttataaaccaatcctgttcatagggtcagagcaaactgcggctttcaaaaggatattaatggttagtgcatttgttaactgggaccctatttattgttcctgtccaactcagatcactcgtgtgtgtgaactaagtactctgagcttcattagaatcgtaattgtctgtaagtaaactgtgatgtacttgaatttctacaattgtgcttatttttcacattttgttcaaataaaccagggctcagctcttaacattttcaaatacttgtttcattttaaaaaaggacaggggccttatttgagctaacagatgagccctcatttctacggaaccctaagcaagatcctatcaatccatgtgctaatggtcttttttattgatgaatttggcccttgctctgttgattgaatctacatatagtctctagccagtgatgcttaaatagaagccacagggtacaacattttggagttgaagttcagaccacacagtctccctttctgcatcccacagattctcatctgtgctctctcccccagcctccagctgctgcactgtcaccagcccagctgagattcagaatcacttctggtgtggttctgtccctcaggtaccctttatgtgcctcagaaacacttttacctagatgtctctctaccattcatacatgtttacagtgatttccttctgagtaaatatatagaactatcaaaatgtctaacctgcccgttactcagttgcagtcctagtttacttcccgcttgatctgattgattccgtttctttggagtattagaaagagagagaacttgcccgataccttctgctttcatctacggctacgatccgatttccttcccttgaatgcatgaaggaagggtttaaatggcatctgaggtaatcgtgagtttctgggttactttgcagtggtttgccctcgatggagtgcacaagaggaaagaatgggaatagccctgccctgccagtgcgtgcctgtagcgaaaacgcttggaaaacaagtgatgcactcctaatgaattgtgcttttggttctttgaatgtgcacagcatctccatcaggtttttacagctggactctagctgtaattgctactgggatgagatgcacaacatggggtgttgaagctaagaatttgtagtgttttagtggccaaaaatacatggcatggtaggagcatcaggcctcatgaaattcacacttgtatatcttcatgttcctcacccgtttctgacatgccgctgatttgccaacaggctactctagatgaaggggataaaaatggcaaagctgaaagatgttgtttcttaaaagatactgtgtatcagtggagtaagaggaagtagattggggatataaatgcataaaaaggcctctgtagtcattcttcagtgaagacaattggtattaatctcatcaatgcaacaaaacaaaaaagataacaattttaatcttattatagcacaaaatggcatgcattaaagtatttctcctaatgtaaacaataattctatatttctgtagcatcagctctcagatcccttgtcctgatttgtcattagatataaatcagtttttatgcttcttccagagaagctttaaagcctaatgtttccttattggagatgttataattccaaagagggtaaaattgatagtttcacagagaaaagtatcctatccaaaattatgatgtaaaagaataatccaaatgcccatgctgatccacccttatggttatttaaggtataatcagtgaggcttggaatttaatgcaattccattggcatcataattttccagggtgtcagctgtgaccactgagttcccaacccagttaaattattctttcacattattctttgcattttctgttttcttctttctttcttttctctttattcctcgggattttttttttttttttttttttttgaaaatcaatccctgttgtgtccatccaaccaaaatattttatagcgcttacgttaactgacattttaaaagcagtttatgttgtagatattaattaatcctgagaacagtacaatgctcaggagagaattatttgaattaaatttgtcaaaagtggtataatgcaaagattgccctaacactgctgaaaggagtaattttcgttgtttccatagaaatgaggagttccttattctttggtccttactcagatcatactacttttgtttaattacaatgaaatagtaaccactaatcaaaagattctttgttctatttagaattcaaacttttgttctcctgaacatatttacctgcctttctaggattactttctaatggcaaaaccagaaaatggcaacatgagagctgaattgagaagaaaaatgcttaccttatgcaagcaccctgtaataaactttgagattttctattgatttttttaatgcccagcgtttgttgtattctttttataacattttttcattccacggtcattttaagctttatttcattcacagtttctttacacctcttgcttttattgaaatttaatttgagaaatggataattaagaatccttctacattctatagagagtaactagccccatggttaatgggtacaaataaatagaatgaataagatctagtatttgattgcataacagagtgactgtagtcaataataatttaattgtacattttaaaataattgaatataattggattgtttataacacaaagaataaatgcttcagatgatggataacccatttaccctgatgtgatttattacacattgtatccctgtatcaaaatatcttctcatgtaccccacaaatatatagacctattatgtacctataaaaattaaaaattaaaaaaaggtttttttttttttttaaaaaaagagtaactatccccacaacagtacatcacaatcacacacacacaccctgaatcctggcagcattgcagtacacaggaatacgttacttgaattgaaactgcaaaagtagtttaatgcaaacacacacccccacataaatacacttttatttattaaaagacaaggaaactaaaaaactgaagtatgaaggccaattggaataataatgtgtgttttacaattttttctcaaatttcctctttaacattaactcgagagtagattccattcccaaggtgattcagccattcaatatttcaaaactttcgttattccctcgagctcagtgccccctctactgcttctcctacaaacagtgatttcccagtaatgccagcagaagcaacagtgaagctaatgcagtcactctgctagggaagagaagttttcaagagaggcaaaggcacagtttccctttttctttcctaccagttaatgccctcagtgggtggtcatgcctgctctgttcttgaacaaaggacttccttctcaggagcagcaggaataaaaccgacaagtatcacatctgtttcatgctgcttctccagttcccatgggatagcaccacgtctatagcagcagttctgatggtgccacagggaaacaaggcagtaggacatcataaatgaacagatcctgcttgaatgaaagagaaggggaaaagaaaatactaaataacaatataatgaacagtggagaagtaaaagggcaaagatacaactcctcagagaagacaaatgttttagagatagtctctatttggtgtaaggtctgagtgttgacatatgtacgtattttagaagtagtgtaggatagagtacatccattcctctccgttcatggccagagaactggtcctgcgtgaagaatgcacggtttaatttgaggaacatttccaacgggtcttaaattctggcctttgctgttactgtctacaaatgggaagaaaagtggtaggcaaatttaaaaaccaaagaggatttaataattataattaataattgaaaaaaagacaaactaagactcaaaacattgatgggaatttataaaattggattggatgatgtttgtagagctctgtaaatttattaaaaattgtatttatgaattcaaaatttaaaattataaatatataaatatgtaaataaaaatgattttaaaaattaactgataatagctctttacaatttttaaaatccctccgaatatagaatagcataggaaaatgctcatgttagtgatacaaggaagatagcaaagcagaactatgcagtacaatcttgattttgatgatatttgtatattaaaaaaaaaaggaaagaaacaaaccaaattttccctgggtaatggattatggatagttttagtttttctcttttcccagtgttttttagatttctgtagttttgttttttctaaatgtttgcactgaaagtgtaatattttatgatgaaaacatacaaaaattttaatgggaagactttttgtcagtacctgccagaattgtttatatggataaacaatttcagtttttcatttctctgaatggatcctgtagaattctatagaatagttatgtaagggattatttaagtattacatggatattaaaaacaacctaaatgcccatcaaaagggaattcatgctgtgtcataatactattcagttgttataaaagaatgaaccttcacaagtatatattatgttggtgaaaaagtaattgctgtttttgccattaaaaataatagcaaaactgcaattacttttgcaccaacctatataagacatattgtgcatatatgtatataaacaatactgtgtatatccagatagatagatagacagatagatagatagatagatagatagatagatagatagatagatagatacacaccctaacttgaaaaaaatacctatgttctattgtggagtagataaagcaatttgtcaaacttaatataaagatagattgcattttcacaaaatgtatgtgagagtaagattgtctaggcaaccttaggctgtataagaaacataaacatctattcttttaagtgaactaagttttaattttgagccactattccaaccagtggtagaaactcattaagtagacacagtcaaatcagagtttcttattaacttatcccatcctaggaatgagattatgaaagtgtcacgggatggtgagtgccatatgctgaattgtgtcctctcaaatttatatgttgaagtcctacccacaattattttttaggacttctatcctccacaactgtgagaaatagttctgttgttccagccgctgttgcctcatgtgtccacactcatcacaagaccctttctgaactctgttcttctcttagtcatttccgtgccatttttcactcaagaaaatgtatggctgccctaccgtgacaccctgggcatagtgggggttggggttggagcaggctgccactttgaggctgtctcagtttcatctgactgaacaccctgcacagccacctttactcctatcctatgctactttaccctcctggaaaaggggcaagatcttgccataccctgattcatcttttgtttctgttattatatccaactttgtggggggtgcaacatggagcgcaacttctcaacacaacaacaccgtgcctaattctcttctgctccagtcatgcaatcacagtcaggtactgtgggggtcaaggggccaggtgctggaaaagtgaactctgagtactcagaaattctttgccagcctcattgtttctagcataagtccaaacttttgaaatttaaagatcaatactttatttattctttacttctgctttaacaactttttttttcctaaggcaccatgtactcacagaatatggagaaaggtacaggagaagatacagtggtggtgatggtaggaaaccttgatgaatatttcaaaatgttactctggtacactgggttatcttgaaagttaggcttagagctgggcatggtggctcacacccgtaatcccaacacttagggaggttgaggcgggtggatcacctgaggtcaggagttcaagaccagcctggccaacatgtcgtgcatatgtagagacaaaatgccgtctctacaaaaatacaaaaattagccaggtatgatggtgtatgcctgtaatcccagctacttgggatgctgaggaggcaggagaatcgctagaaacctggaaggtggaggttgcagtgagctgagatcatgccacggcactccagcctgggtgacagagcaagactccatctcaaaaaaaaagaatttaggcttagagaggggaaggggaaactttcacttttacttgatataattcacttgatataattcactttcacttttacttgatataattctatattattaaataattatccctttaaataaaaagttaatcatttttataagcttcatatcaattgatccttataacaatactatgatgtagcaggggcagttactattaacttgtattttaacagatgaataaatgaagtcattcctacacattaaaagtatcttttgatctggaacaagtaagataaaatgagaggcaaacatataatgagtgctttcagtgagtaaggaatacactaggaaaaaagctgttacaaatatcctaataatgcctaacatttctctaaacccttattgattagaaaccattttcaaagttatagtttttattgattattcttttgaaatagtttgtgtccattcttttcttcctaaaggtatctcttccatgcaggtcttcatggttcatgtttcaactaccaccagatccttcgctcctgccaatcattcctgccccagtatgttcttcacctcacttgattttactaaaacattgcttggatcacgtcatcataaagaccttaggttggaaagagcctcaaatgcagcctctcgcctggctcaggaatcttttcaagaggatccctggcataagattttcctgcctttttgaaccattggatagggattcactgctttctgaggcagcttgttctatttttagcttaaagtatcagaaagttccttcttttggctctactgaatgcttctctttaacttccacacaaaatgaatccaatctttcttttatgtgaaaacctttctttaaaaaaaaaaaaaagaaattgtataaaaaatagagacgaggtctcactatgttgcccacgctggtcttgaactcctgggctcaaacagtcctcccgccttggcctcccaaagtgctgggattacaggctgtcaccaccatgcctgggcagtgacaacctttcaacaaatatgagactataagtcttttcacctcaattattctcttcaccacaccgaacattcccaattcctttcttggtgttttcgtttgtttttttgtttttgtttttgttttgttttttttttttttggtccaatatccctgagaccaccacagttcttgacacacggtaaatattgaaggcatatttgtttcctgagttaatgaatggctaaagtgccctattgttacagcattgctttggttccagttttataatctgtaaagaaaggcatcaatacgtgtcctccatctggtagttgatctgcagtaactcctgcaatgatctaacatctgtttctctcttcttttagcttcacagaaatgtcaaatatttctatggcagtgtaatttttaaatatacaagtttattccccctcttagcttttatgtctgttgtttctgaacagctcattacaacatgacagtataaatatcttaaatgaatatgtgccgtcttacttatctcctgttgttgaaacagttcccatttggtttttacccagtgtgtgaaaagttctgtttttcattagtatccatacattatttggccatcaccagaatgaggcaatacagctttattaatatgttcagtcatatagttagtaaagacactatgttgcacagtttataaagtacacgtcttaatggaacagggttgaattatcagagctattcctggtgaatcatagtcttggttaccacccatttttgcttatttatcctgcctcctagacttagtttaacactcaagataatagaaccgaagaactgagaaggtaataaatcagttcattcttctctgataataggtgtgttggctataaagattgaagatacaattaaattatatgtgaattttagtcatatctacacccatttactacaaataagcaagaattttttattgtcaagtttcttataattatggttcagaagcagctatctcaagtcctcccgaaggatatagtgtagtgttgccactatgttgattattcaaccatagaatttttaaaagtataaagccaagtacctccaggaatgaccttaattattgaaattagcatccctcataccaatgatcatttaccagtatgttttcaaactttctatcttaaatcacagtactataaatttttatagtacccttttaagtatccagatttctctttattaagtgaaatacacagaaaacacatttcttgcttgctatatgtagcaggattagacatctacagcattatgctttcaagaaaatttttcttgacattgtttaagaaggagagagaacagtgagatttccacatctgttaaataatcattagcatgtaggattgaattctgtcttctttttcaacctaagaccagctgttgaagtaaactagaagggccccttaattattgcatatttcaatagcttgctgaggattcagttacctagatccaccactctgatcaaaggggactgatttactttgtcaccattgttattgaaagcattccttatttgattgttttgcttctaaaatgttctataaaaggtcagacagggtgtctttctctgattccatcaggcctctgggaagaacctctgctaccaattatgtgctacttggacgggtgctaagacattgcacggcttctttcccttggccttcatacaggtttgcttttgtcaccaatattgctgagtcaaaggtgtcttaatgtccatatggcatttggcatcagtgaaaagcaaattcagaaaaatgaacttatttcctcttgtttgtgacgcgatttggtaccattgccgaggagacatttgccatgagttgtacatctgtatcaaaggctttaatttattttaagggtctccttattaccattggcttcatgattgtttttgtaaacatggaataaagtcttaacctggcataacccacagcctagggactaaacaaaactaaactaatgcctgcaactttggccctccacaggaaacaccgtaagaatgattgaatatgaaaatcaaattttgactgcttccaaatagatcacaatactgaattatgccagtgttgtgtttattgtttctctcttccagcctttcacgcactgtgtcaacttggccaacagcagctatccatgagctcttgtatgtggcaggatgggtgttctgtctttatattgaggccaccaatggaatgtcattatgcatttacaaagatgcacacctgtttggaatatgccctcatgcctccacaattaacaagtttttaatctaaagctgttttcacaagtagtagatgtcagaatttctttgaaatctcttcatagcagacgcacaggtgtgtttgccaggccactgttcttttctatagtatttcactattttcaagatgaaatttattggtatgtatagtgacatatatacaaatttattggtatataaaggaggccatattctttactataatgaagctttttctcctaaagataattaaagtaatgaagcatgtgttaactacatactgcaaaggatatgtgaaatgggaaatggaaaaaaagaaaaacttctaaatagagaggtaaataaaagagacataatctatgccctggaaatcaaaacgtaggtcgtagagcgcaaaagggagtttgctttttaagatttgtttaccttttttgtgatgggataacatagaagatttttagtccattgtctctattgtcaaagtatgttcagaattcaacaatttcctgtcctctttattgccagcacactagccttagtcaccattgtctctcacctggatttctgcagaggcttcctgtcgggtctttctgctgtcacccttgacaccttccctcccgtcccatgcccaccacgtctgttctcaacataggccagagcaaatctttaaaagtgtttcagtgtgtcactgggtcctcagaactttgcagtagctccccatctctcagagtgaaaggtagtctttaaaatggccttccagattctacatgacctggctcctgttacctctgaacctcctctcctacttcctcctgtttctggaatatatctggcatggtcttaactaggcctttgtactgtcccttatcaggaatactcttcgggcagacttcttcctgcttaactctctcatctcttccattcagtctttgctcaatgttcctgcttaaaattgcagctcatccctgctacacacaatcaggagacttcccaccctactctattttttttttatataaaacagttactgtgtatcaagttaccatataatttactttgtaattatattattaattgtctccccccaatagaatgtaatccaaaaaaaaaaaaaaaaacagaaataggctctgttttgttcatagaggtaactcatgcctagaacagtgcctggcacatgcatagtaagtgcttcaaaagtatttcttcatagaatgaattgaatcaaaactggtaaagttggaaagttggtgttaaggggaagatatgagttcagtattgtccttttgaattttagaagtaagcgatagagctttggaaagagaataataggactatagatgaagttatgggaatcatgtgcacctaattcatcagcaaatcctgccagttctacctccaacctaccttcaagctgtactgcgtttcacctttaccacagtcatgtaagccagtattgtctatcacctggcttattacagcattctgcaactagtcaccttggatctgcactgaaccctcaacacattttgagctcaacacagtgagttggaaggcaaggatccagggaagatgaacaccaaaacctgcagaagagagggaataattagtaaagaggtatctgaaagaaggttggagaaacagaatgagaaggggcaaggctgccttttcttttgaattaacgggaagtggctttagaaggtcaagaaggtatgagtaagtttaccccgttagaatggctaaaatcacagagactaacaacctaaaatatcaggcaggatgtagagtaattggagctttcatactttgctgataaggatttggtatggtacaaactctttggataattgtttggcagttgtctataaagttaaacacttacttgtgagccagtaattgtactcttcaatatttatcaaaatatgtaaaaacacaggtgaaaaactgtttatagcacccttattcagaattacctaaaacaggaaacaactctgatgtccatcagtaggagaagggattgtgatatattcattcaatggaataatattaaacaataaaaaagaacaaagcacggctatacatagaaaaatgaatgcacctcaaaaacactaggttaagcaaaagtggccaggcacaaacgagtacatactgtatgattccagttacttgaatacataaaatccaagaacacacagaaaacatttatatggtgacagatgtcagagagtggttgcctggagtagtggggaggaggaagggaattgtctggaaatgggtagaagagaactttctgggtgaagacagtgtgtgctatcttgttttggatggccgttagccaggcacacacagttgtcaaatttgtcaaactgaactcttgagatcggtgtactgtactgtatgttaattacacctcagttaaaacatgtaatcaaaatctatgggcctatgttgggaaattctgagataaacaagaaggaaaatgtgataccttaaatgcagtggctcaagtcttcttagaaaagtagggtacaggccaggcgcagtggctcacgcctgtaatcccagcactttgggaagccgaggcaggcagatcacttgaggtgaggagttcgacaccagcctggccaacgtggtaaaccctgtctctactaaaaatacaaaaataagccgggcgtggtgacatgtgcctgtaatcccagctactcgggaggctgaggcaggagaatggcttgaacctgggaggcggaggttgcagcaagccaatattgcgccactgcactccagcctgggcaacagagcaagactgtgtctcaaaaaaagaaaaaaaaaaaaagaaagaaaggaaagtagggtaccaaattatgtcttgagcttgatacatgagtgattagactggaagagtagaaaaagctgagaccagctactttacgaaatgtgacaggacgtcaacaagagaaaactaaagtattaatgggcagaagtgaagacccaggcaaggcagccagtgatgactatgccacagtggaaccaggcaacatgattttgtggtttacgggtgagtaaatttgataactgctagttaggaagccagacaattggagtctagggcattcatgtctttctggaagcctcggaaaaggtgaggtttgaactgtgccttgaagaataaggtgaattttactaggtagagaatgtgcaggtaggatatattagggtaaataaaatgtatcactaaaattaactccacctgcttcttttgattttagtttggctactagaaaattttaaattatgtatatggctcaagaacatatttcttttggacagttctagccttgaggcatagagataagctattgccgtaatcgaggcaaaagatgatgaatgcctggactcagacaatggcagcagggatcgaggaacagtaaaattcaagagatatttctaaggactgaattgactgatggaggttagtgattacatttgatggggaaagggtgatggagcaggacaaatcaaagattgctccaagttttctaacttggataatattgattgggaggggaagccatatatcacattagagaaaatacaggaaaaaaacgaagtagatttgcaaggggaataggaagaaagaataccacatattgactcccaggcacaagtcacatattaaatcatgttcatgcctgcaaagatgtaagaaattatgacccagagagaatatttagctctgtggaaaatcagtcagctagaaagtggaagaactaggattcaaacccacaccagtggcggtagtaaatgcctttaaaacttggaaagggccggccgggcgtggtggctcacgcctgtaatcccaacactttgggaggccaaggcaggcggatcacgaggtcaggagatcaagaccatcctggctcatctctactaaaaatacaaaaaattagccaggcgtcatggcaggcgcctgtagtccagctacttgggaggctgaggcaggagaacgttaacctgggaggcggagcttgcagtgagtggagatcgcaccactgcaatccagcctgggtgacagtgcgagactctgtgtcaaaaaaaaaaacaaaacaaacaaacttagaaagagccaatgagcaaactatggtttgggttctgtaggtcgatgcgtgtgtttatcctgggtcacactgtgagaaggctgtgtgctgtaattagagtttgctctaagaactgacagactaacctggcacacagtaatcagaaatggcaagattcatattcgggggatgatttttaactaaatgctagattacagaatctgtgtcattaaaatcaaacagctgcaaacaaatatgggtaaagtgcagtcctatggcaaacacaacaaataactattgtgcttactgtcttagacgtgtaaaggcccaggctatgaagatgaggctgtattatcatgaggacatgccctgttcatgttgtaaaactttttttaaaactataccttaggccaggcacgatggctcccgcctgtaatcccagcactttgggaggccaaggcagacagatcacttgagcccaggagtttgagaccagcctgggcaacatggcaaaaccctgtcttttcaaaaaaaacaaaaattagctgggcatggtgacatgtgcctgtagtcccagctcctcaggaggctgaggtgggaggatggcttgagcccaggaagcagaggtttcagtgagccaagatggcaccactctattcccacctgggtgagaaagcaagaccctgccccacacatgcacaccctgcccccacaacacacacgcacaaattataccttgttttctttgtattttcttcccttttaaaatgtgaaagatataaaatatttcagttaacttagaattctagttaattggattagattttcctgataatacattttggtattatgatctatgtttcagaaaatgtaaatttccacagaaaaataattatataagaaaccattggtatgagcactttaagaatgtagatttttccaagtgtatataattaacatagaagactgaaagtttcaaacaacgtgacataattataaattgttgtgaaacaaaaaccaaagaccactgtggcacacagcaattaggaatgataaaactgtttattgttgttgttgttgttttgagacagagtctcgctctgtcacccaggctggagtgcagtggcgcgatcctggctcactgcaacctctgcctcctgggttcaagcaattctcctgcctcagcctcccgagtagctgggactacaggcgcctgccaccacgcccggctcatttttgtatttttagtaaaaacggggtttcaccgtgttggccaggctggtctggaactcctgacctcaggtgatctgcccacctctgcctcccaaagtgctgggattacaggcgtgagccactgcgcccggccaatattactgtttttaaaacagagactttgtactgattcttgagtagcagaattgcacacaacagcatattctttttaaacagccacaaatcagagattagtcttaaaatgagaacatttttgtaaagacagttacttatctatcatattggtcttttcatccacacttaagtagccatcagtctggaggaacatacttaaatgccagccacagcagtataatattttagtttactgagtcacttacttcagtaccgtcatggtaaactcaggcacaagtctacatttaattaatagtacattaagaaatgcagtagccttgaagaattccacagcggagttgatcttaatgccatagtcagtgttgagaaacctactcattcacagatgggtgtacctctttccagtgactcttcccaaattctagcaaactgatatatcagtcacttctatttagagctaagtagaaaaaaacaaaattgaaggcaatcaggttaaagaaacttcctgtagtggttttaaaagagagtagaaatagttgctcacagatttgataaaaaggcttgaattcacgtaccaactcatattcattgtgatacctgcctgattcagggatttcagtaatttttaggatcttgtgggggtcagaagtgccataaagattaatgatacctgttaaggtcacagactcaggctggcagtggcagttggggagtaggagaggaaataaagagagcttcatatagttcatctaggttctagggcttggctttgctgctttagcttagatcaaatagtaatttttaaaactcttgtttattgatcatctaccatcaatacggattgtgccagatattatttcaatgatttgcattctccttaaacctccagaggtagtattcatagctgttaatccacattttctacattagaaaagtgagactcggggatttaaaattgagtcagccagactccagaggcgtcacttaggttttgtatctcagcattgtcaggatttgagtaggacttaccgaataataacgctttctggaatagagccaaagtttgtgtgtatatacgcttatgaaccaaatatatatttttatattgacaacataaatgtatcaaatcaattaaaaatattaatttggaataaatctccatagggtgtttttataagttttcaagtatattcctcagaacaaacattaaagtaagctttttgacacaggaatcaaatccctcacatcatatttttcagagagcatcacactattatagtgatgaaattttgtgtgacaccatcagaaacaactgttcataaaagaagcaggggtattattacaaggaaatgttgaaaattcagtatatttgtattttagcctagtttcccagattgaacgaatgccacaaatatttattactttagagcaacatgtcggttaaaatttctgaacagtttctgaaggatttgaaggtgggtactagagagacagagaaaagggaatactgaagctttatatcagaattgaattgtgcgatttcatattaaaaagaaaggagaactatagttctcttccagttattcccaaatgttatgttttatttattaataaggaaaaatattgagattcatatttcacacatcactgaaatgactgtgcttaagcagaaatttttttcacacttgtcattatttactactttttagagcagaaaatgtatattttgttgttcaggaataaaaataggttacaataaaatatgaaaaactaaaattaattcttcttaaaggcatttagctaaaagtattttgtatttcatttcaaacacaggaaagtactttaattcaaaaaagacttagtttttaaatatactgccttctccattcatgactcaaaatgctttctcataatttatcccaactctcataattttttattacaacaaacttggaaatttcgtttggttatgttatttgtattctttcatatgcctcttttcaatcttttaaaatgacttgtcatgtcaaattgaataccgtagcgtgtggatttctactcttatcagaactgcaatttaccatggctttattatttattatttatttattcactaatttattctcctctttattccagaaaggatactcataggaagggcttacttatggattgctgtcatttggtatgcattacttcatgcatttatttattgccatctctactaaattgtatttatgaaacttttcctttattagtttcttgctttagaaatgaagcaaatgaattctcctgagccactatatacttatttaaaatgtaagagcatttcattgagccatttataggttttatgtattatgtattttaactaaaacacattaaaatgtattattttggcctttctgacagtcatttcaagtgacagagctttcattttaaatggcaaatcaccttctaatacacctaaaactggttatatttttgatcctttttctcttctcctaccctactattgtctcaaactctccctccctgcaagatttggtagtaagaacgtaagcttctcaatgagctatttcaaaaaaatttttttacaatgcaattgcggatggtttgttctgcttgcagaatggtattttattctactcccagacatatagccatatgtttcctgtcacctcggtgacacagataagccttacatctggctgtctttacctaggttatctccccaacttttgctaaacttgaagctaatatcaactttataaatttttggctttataaccgatttttgccttctaaacaaaggattaagaaaagccccttattactgaggaagcactgaagattttgttgagaactggttggcataaacatgtggtaaaatcgtacagaagaaatacacacacacacaccaggaatacaagtaaaactggagaaatctgaatagaatcaatggattttatcaatgtgattatcctggtattttacaagatgttaccattgggagaaactaggtaaaagtatacacaatctctttggattacttcttgaaacttcatgcgagtttacaattgtctcaatgagatttttcattgagaaaagaaaaacgggttggtaaactttttcttaaagggccagatagtaaatattttaggcttttcaagagccatgaggtggaaacttctcaaatcctttgttttatagcacaaaagcagtcagtacatgaacgagtggcggctgtgttcccatgaaactgtgttacggaagtagatggcagcagacgatagtttgcagacttctggtttaaaaagagacacaggcttttaatattccatctgctgctcccttgaaggaaaaaatgtggtaacaaaagctaattatatatttatggtgttgtgatttgcagcttattttctgtcctcatgattttcttaacttgtatatttatacataaagaataacatttttgtttattttaaatattctaaaaagcaccactttggtatcatgcttctctatttggggaaatcaaaacatttaaagttacgtgtcttagaaaagtaagaaattctttttagatataatactgtattaaaggaacaaataacactgaatttctgtccttaaggttttcatccctaaacatgaataataataagtcagagagtaaagttctaggttgaaatagcaatttctgcacatttcctcatttttattcatccggttacagagttgaacatcctctggaagaatttaggttgtattcagttattctcattttcagggtgggattaagcatgaccttatgcagaattccactttaaacaagaatgccctcaagcttactttagacaatgttaagaaaatccactcgatgagattttgatatttattcggtagatttttttaactttttctttctcttcatcctgtcacatcatgagcagtttgaagacatcaggttcagttccctagcaaaaccaagtttcttcctcctagtatgtttctttttccttctgctttgagtggcttctgtggaaaaacatcttatatgtgggataaaaacgaaaacaatttgtgtgagagacacacatgcggtaggtctgtactcaatgctgtggactgttaaaaacaaagaaaggttttgctatttaaaaggagaggtaatgcaaatactgcaatgcactcataagaaaaaaataaattttccagtaactataatttaacagcaatataagccagtcctgtgtagagttctaaaatgatgagagtggttagagccaaatagggttcatatgatgagatcttgtgatgtgaagtaattttaaaagatgaaagatacttcttaaatactttggaaattatatggttgaccctcttttttacccaatgcttcatttagtgtgttgctaaagctaatcaatttattctgcctcttaattatctcttgaatctggccctgcatgtttatctgcattgccagggctttcgtttatacactcaatacaatactataaatctctactaactctcatcacccagcacctaccaaaggcaacacacacccacatacacacagcctccacactgctgttagggtagtcgtcataaaatgtgtctctgaccttatcatgtatttgcttaaaaccattccacagctctctttggctaataggataatatgcaaatgccgaagcggaacaaggcaaggcccatgaaaatctttattccacctgtcttccaggcttcctttcctgcctcttgcgagttctcctaccctgtcccagccccacccacaccctctgtgttctagccagtctgaaccacggcagcttcgtgctccctctcactgtcatgccttagcctctttcggtcgtcctgaaggcttctctgtttggaatatgcattcttcacagcaactaaagcattagcttatcggaaaaaccttctgagaagctttcggaacccagcatatttcatctcttagattatttaccagataatacttcatctctctgtatatctgtatgctcaaaagcgaggaggcaataaatatagtgtagtagggaggaaagctttaaaaaagcaggaaagtatctgtttgactcatactggaattcctaggactttgaaagtacctgaagtacagtaggtattctatgtaggtgtgttgtataaattaatgagggaaacagtgaatgaataaatgaaggcaagaattgtgtcttactccttggaatcagattggatatcagcccacgaggcatttctaaaggtattaagagtttaaatgaggactctgccatctgcagtattgctatattgaagaaatgaatgtctaaaggaaattcctaatcatcaagtaagaaaccgttacacaggagactgcagtggttatttcagaaatagcagtggagtcattcacagttaaatgcacgcgctctattaacaacctaggaatccagggaatctggaagaaaaataaatttggggaatctatttttattagcgtgaatatctatggttttcatgcacataggtaatagtacttatttatccagtattaactatctttatgattcctcaagtactcagaaacttaggagatggtacacataaatatcctaacatgtaaacatttctaaaccattatcacctctgaaatctaatttattgccttccctcctgaggaggattcccatttttatttttaagtttttgcttaaatgtcatattttcagtaaatgctattctgatgacccaatttaatttttttttttttgagttggagtcttgctgtgttgcccaggctggagtgcaatggcgcaatctccactcactgcaagctccacctcccaggttcaagcaattctcctgcatcagcctcccaagtagctgggattgcaggcacccaccaccacgcccagctaatttttgtatttttagtagagacggggtttcaccatattggccaggctggtctcaaacttctgacctcgtgatccgcgcacttaggcctcccaaagtgctgggattacaggcgtgagccaccaccccagccccaatttaaaattttgattccttctccagcagttctaatcgcctaccctgccttgtattctgtcaatatcaccttccctttcatttactaatttattatgtttcctgcatattgttctccccttcttcccctccacttgctacaatgtaagctctacaagggcagaggtttttatgtttgtttttagctgtgataggtgcttgataggtgctgtgataggtgcttgagtgaatatctgtggaatgaatgaatcaaccaatactacatgagtctctcagctcacattcttaagaaaatagtcatcacttcacagcctgattgctgtcacatggcccttaagaaaatagtcatcacttcacagcctgattgctgtcacatggcccttgtactctggaagagcactcaggttaatctccctctgacttcttttctcataataaatttcttcccaggaacctctgtgtggcctaccaaatcaggtacagattcttccacttggaggtgaaagtggttggttggccccactttatctatccagaactctctcttaagttgctttccaaaccagtgttgtttggaaatctccagtcttcctgctttgactttgctaactgtgcttctcttcaaggtttagctaaatgttagtctacactttaagccttcgaaaccaaccccggcacaaagcaaatgtttccttgttcaccttcttcatgtagtttattattttgcacctgcctgagatttgtgttctcgctgtctcaggaatggaagtcccatctcctcaattagggaataagcccctttaggccaatacacctgccttcttctgtatctccacggtacttaacattatggataaatacagttaggacttgtggcttcgcagcggtgaaccattgttggttctagacaaaaaacaaagttttgaaaatgccatgttggttttaaacagaatatattggagtagagaaagtcagtaggcagagagagcagcattctatttcctcagagcacatatctagtcagcagagagtgatttatttaataaatgagaggtagggaagggtctaggtaggataatgcaatgggaaaacagaggaaagaacataaccaaataacattttgaataagctaacaagaaaattgttgatttggatcaaagaatcaaagagcaagagtcaaaatgtcaccaaacttttgagtagaaaatggggatttcagtggaaaggtgaaatagttgagaaagaggaggagatcttggattgggcagagagtataaaacgaggatgatacatttagtttgggacagatggacagtgcacatagggaagagagaaatatgttttcctttaagattttttagtagaagagtaatgacattacattggctgtaatggatttttgaaattatttccacaaatttgaaaacttctctttttttccgccaatatggattaattttcagggatcatattttgcagtgaacctttaaaatctcatcagcttattttaaagcaaagttgttacaggactctggtataaggaaagttacattaattgaaacattcatactagtataattgtgctataattctcatttgaagtttaaatgaggtttagtgctggctacagagggagggacacactggaaactaatttatctgtgagaaggcagaggagcagagtatgacattttggtccttttgagaaaatttgcaggatgttgaggtccgttgctgctgctgctgctgtttctgttgttttaaatagtatataactaagggtgaggaccattagaggacagaaatcacatcttaatcagctttgatttttttatgtttaaaaaagagattgagattcactttgtagtctagggagtttaattaaagtaagtggagacaaaagtactcttttgagagctgtcatttctcttagtgtgacgctattaataatgtagtgtaatgctattttggaagtttggttctttccttttcttttgtcttcctctgactcttttctgtattctaaatgaaaggggaataatgcacttagaggggggcactctcctaaattcactgtctcatgtacgacattatctccgacttcggctctcatgttttgaaaaaatacctcttcatcgctctatttttatttttcttcttcttttattgtgaatctcttttaccaaaaacatttgtagggttcttcacaaagattttttttttcaatcaggatgaaaactagatcatgatgtgaccatttcactgtgagtgtaacttccctttttgacagctccattagatctgccaggttataaatcttcatatttctgacttgccttgaaatcagaaagtgttttcattatgctagtctctgtgagcaacaagcatgaaggaaggcatggcaggtatcatagcccctttgatgaacttacctgtttcaactcagtgccagggcagaacatttactgctaaccctgatgggtcaactttgattgcaaattatgtgtggtacattttgaatttaaagaatgtttctgagattattctacgatcacttgtcatttttatgtgtgcagtaatgtgttgtgtataacttggatttcaacaatatccattgtttgaaagttagaaaatattctaagaatactaattatcttgctcaaataatcatttaagtacaactgtcacttgattatggtgaatatttttaagtaaaattatatatttaaggtgtgctacctctaattttattgtcatacaaaaagcagattattgaacatgttaatgtaaattgtacttttaattttttccagtactctagaacatgtgtaaggttaaaagaatttaaattacccaggtttttctttttacataataaataagaagaaatcacaaaggaagcagatattatattgtttttaatataacatgaaattgtttgactttattttgatgacctcacaaaagtataaacatggcagtggtgtgtatgatcaaagtaagaaattaaagagttaccggttctttataaaccagaagtccattgacttttaataatgctgtctcaaatatttgatagtaaattgtggaaataatcaaagctgagcctatgggactgtactttgtagtactgtttaatttaataactctaataatcccttaagaatattaggaaaaataggccgggtgcagtgactcacgcctgtaatcccagcactttgggaggccgaggagggcggatcacctgaggtcaggagttcaagaccatcctggccaacatggtgaaaacccatccctacaaaaacacaataattaggcaggcatgatggtgagtgcctataatcccagctattcaggaggctgaggcgggagaatctcttgaacccaggaggcggaggttgcagtgagccaagattgcgccattacactccagcctgggcgacagagcgagactccctctcaaaaagaaaaataaaaaagaaaaaagaatattaggaaaaatatcttaatgcaaaatatattaattagtaatctgccaacactgagatgtactataaggccaagaagaaaaggaatgatatctagagtcttgtcattttttaagtcattgcttttagagatttttttaacctcacatatatttttgtttcttagcataagagggaggaaaatcaaaagctcaaatagagaatttaaaaatgagacaaaagaccgcccacatactaaaaagtgttaattataaaactggaaactaacattcaaattattttttcatctctgttcccctatttaatatgcagtgtagtttccctgtaacggaagaatgcttctgctatcacggctggactggggtctccacactggcctttgctggatagcactctgacctccagctcaaagtaaagcaagcattcttccatttaaaattgaatttctacggtactgccttaatacgaatacttcctcttcatttccttcttgacaacatgcctggaacaaaaatgacaaaaataattattcctgtataaattagtatggagagctttggggtcatactctgtgaccattgccagatttcttgatttctctgtacattttttcccacttgtgaaacaggaatacgtacctacagcttaaggtagctatgagattaaacaggatagtgcatgttaagcctattgcgtaatcagcttaataagctttcatgagtataaatttctgttgtgtattccaccggcctatgtgtgtagaatccatatagttacgttgaacctagatttttagtaagtcttttttgaagttactaagtaattaaattacttataaccaacaaaacaaaaaaaaacatataaaatagaggagaactatataagtcctttttttaaaaaagtagcaaacagtattttttagtgtcagggattaaaggaattgttttagactcgatatggacgtgttagaatgctttaaaaatcgattctagctaatggagagaatgtttttaaaatgaactattgccattccttcagtgaaccacatacaacaagaaaaaattcacataaacattgaaggaaaggcaagctcttccttacagaagtaatgagaatcgcagcgatttgccttggggaattagaatgtggagactcttttccctgtgcagtatcccctaatgtctaggagcagataagtagcctctaattttaaatgtgcagttatccaaacaagatgaatgtgcagggcaaagctggataagaatgtcgatcttaatgttaatatttttattctccttcgtaatcgacatatagttggcaaaagccaaatgtctgtgagatccctaaagaccacagctaactcaggagagctgtagccagctttatcttacatcagctgtggagatctggcccgagggagacacatcccagaataagccccttgccattgtcctttacaatgttttaaatcagttattttatcttgtctagatttatattttgtaaaatgcaaactgataaagcatgacagcattcaagacatagagttagcaactgaagcttaaacctctgtgtgtgtgtgtgtgtgtgtgtgtgtgtgtgtgtgtgtgtgtgtattttaggtaaaatattatatagagagatttagggaattcttttaaaaactggaaagaaagacattagaaatcataatctactcccctaatattacagatgaaaggaaccaagactagaagagtaaaatatgttagtgataaagccagtacctaaatatgttagtttgtgttcaaagtaaaaatatcaaatataagaatcgtcttcttttcatttatatctccctaatttttatataagtaagattctatttttaattctagatctttgatatatgaaaatgacttgtatttgaagtgtttaatttttgaagtttttaaaattaatgtcagaacactagattcctcttaaaagtaaattagtaattatattttaaaaataaaatatacattttggcaatacaaacccagttatcatttaattgttagcatgtgttttctacagatatattttccttactaggcagataatgtacatgcttgctaatgaaagctttgtgagctatgtgtctttggcacttattttgcataaattataatactgtgttttactaaaatatgggttaaagcaaatatattcaagacagtgtgcaaatgtgaatgcaacagattccaaatagatgattttttattgataaatagtaatataagttttactgcagttttaagaatcatcaagattttcaacagaagggcttatttgttttaaaccctaagccgcctttctgaaacctgaaaaagatttgtgaaaacagcctgcaataaaaatcacacacacttcataaaacagtacttgatagatatcacttgcaccattaagagctaaacgacaaaggatgtaatttcagttctggcatgcaatattaatcgaaagcctttaaaacatcttgctgatgggaactatgacaacatgacattgaagaattatgagctaaagacatctatcttaatcagatttttgaagtaaatgccataaaacataaagttgttttcttcatctttacatttttacatgtttttggtgggagcatgattttctagtgtgttgctttaaatgcagagactgcaaaatcagtatttaaaagtatgagttcagtacacagagttgaagcaaattttagtcaatacactctgcatacacagggaattatttctgtaataatgtacatttttccatcttttatgccagcgatttgtcttaagcaaatactttaaataaatgatattaatagatattttggaaacataattaggtgtttctttgcctttttttctttttttgagacggagtattattctgtcgcccaggctggagtgcagtggtgccatctcggctcactgcaacctccacttccctggttcaagtgactctcctgcctcagcctcccaagcacctgggattacaggcgcctgccaccatgcctggctaatttttttgtatttttagtagagacagggtttcttcatgctgttcaggccggtctcgatctcctgacctcaggcaatccacccacctcggcctcccaaagtgcagggattacaggcgtgagccaccgtgcccagctgtatatttgcctttataaatttagaaatgaaaacagaatgcttgtaaagacctccccatagaaagaaattatcttatggatatactaacatgtaaacatctttttttcctaaaagaaatacggcaaaaacatttattactttgtttgaataattaagaaaagcctggaaattaactccttccactaaaataacacttcacagtttataaaaatactttaatatacattatctcctttaattctcacaacatttccttttaagattgattattaccccattttacaggtgaggaattggagtatttacaataggaaattgatgatatagttactaagtttgggacagggagcttaaactgtcccatttgggacaggaaaccagatgttatgggctaaatgtttgtgtcccccaaaattcaaatgttgacgctgtaatcccctatgtgactattggagctagggcctctaaggaagtaattaaggttaaacgaggtcatcagggtgtagccctgatcctgccgcattagcatccttataagaagagacaccagagggctttgctctcctgcattgctcccctgctgtctgcctcgcctcagcaagaaaacagccatctgcaagccaggaagagaactgtcaccagaaaccaaccgaccctgccagaccttgatctgtgacttctggtctctagaactgtgagaaaatcatgtctattatttaagccacccagtctatggcattttgttacggaagcttgagcagaccagtacgtcacatctctattctcttcatgatatatccagtgcttattcatctcttctatggacaattttaacaaactggcaccaaactatgtgtagactcatgaaatgaaagctcataagatccatgaaagactatcttagttactgcttctttttgaacctttatgttgagaggaaggttcctagtggcagtgagcatcttgaagaaagatgcaggcttccaatctcaatatatcatgtttactactattttaaaaggcacaaccggctgggcacagtggctcacgcctgtaatcccagtgctttgggaggccaaggtgggaggatcacttgagaccacaaatgtgggaccatgtggggcaatatagcaagacccccacctctacaaagcattttaacaaattagctgaggatggtgctgcatgcctgtagtacccgctactcaggatggtgaggtgggaggattccttgagcccaagagttcgaggttgcagtgagctatgatcacagtactgtactccagcctgggcaacacagcaagaccctctctcttagaggcacaaaaaagccttagaaaatacagattattaatttcccaaacaattataggaccttacatttatagtacttgccattcacggggcattgtcatatacgtgatcttacttcgatgttggccctcatgtctcccatattcagtattcttttcagtgtaccatcctgcctttcataggtgctcagtcaaagcagcataaaagcatatattgggaagaggcttttagtgttgtatacacacaaaaaacatacccccaaattgttaatgacagagaagggaattcagcaaatacacgtctatggtagcttcatctatgattctattttccttttaatcaagaatgatcattacatggtttccacttaacagatcactctcattgcacgtgccaagaatagaaaggatacgctgggttccattgaagttcattgcatctacatatttcatgttcatgataatacatatctctgcctagatgtcatactatgactggaaggacacttaaatgaatatttgatttgactttgatgtaaaacattaaaagacagtagggactcaataaactacaggtaagaaataacatatcaaataatatgctagaaaaaaataactgcaaaattaatatatttttgagaagcaagatcagtagcgtcattgggaactttatctgtgtgctcttcaattatttgtttttcctatagttgctgaaatatttaagaaagaagaatcagaaaaaaagctcaaagcagactgaatctttttgctaaaaataatttttaaaatgtattataattgtcttcataacttttataaaacagatcagttttcttttaaaatttttttttaagagacacagtctcactctgttgcccaggctgaagcacagtggcatgatcatggctcaccgtagcctcaacctcctaggctcaagtgatcctcccatctcagcctcccaagtattaatagttggaactacaggcacataccaccatggccccattaattttcacatttttttgtagatggccaggtgcagtggctgacacctgtaatcccagcactttgggaggctgaggcaggcggatcacctgaggtcaggagttcaagaccaacatggtgaaaccccatctctactaaaaatacaaaaattggctgggctaaaaatacaaaaatttttgtactaaaaatacaaaaatagttccagctactggggaggctgaggcaagagaattgcttgaacccgggagacagaggtcgcagtgagccaagatcgcaccactgcacttcagcctggcaacagagtgagacttcgcctcaaaaaaatgttctttgtagagatggattttgtcatgttgcccaggctggtcttgaaatcgtggtctcaagtgatctgcccacctcggcctgccaaagttctgggattactgatacgggccactacacctggcctggttttcttttaagcttgaaagatgcatcctagccttttacatagttatttttacaatttgtttaaaaattttttacattaaaatctgaaataaatttaagttggatataaagtgattttcattatatgtaccttaagatgttaatagttataatacaagataatatggatgagtttatttttaaaataaaggtattatttttaatgtctttaatataagatagtatggtagggtattttatgacttgagttaatacagtgaagttttcataatacttgaagtaaaattttttgtactatcaatcccttaaatgttttatatgtataacttaagatggtatgatatggtttttaattactttaaatttcaaatacccataacataagctaatatattttaagattttataatgtattacctaaaataaagggaattttaaaattgaaaaacttcagacttcattgcatgactccaatcctgctctcccctcagaagttaattgatttatatagttaggtttagttagagtaagtgctcagtcctgtgtctcctgtttccttttgtagtactcttctataccagacattttatttgtgatatgttatctgaaaagcatagcaaattctgcattgtttgaactatgtgatttgctttccttactctttataagccacactttataagtcacaataatgtagctttatttgccttccaccctgtccttatctatattacaaatgtgttttatttatatcatatcatatatactccatttaaagtcaataaaatttaatttcactaaaacgaaatgctcataataaggtaataaggggagagaaaagcgttgattgatttatgtcagttctttattgtcaagattgggacagcttcttccttttttgcttactctctcaggtaaaatattttaaaatgggtagaagaatatcctgaaacatacactgagacattttaaaggtatttttatccagttttttatgcatgtataaaagatatgtttatgtatgtttctgttagaaatgattatgcaaaactaagaatttcataggaaaaatgtgtctgaggcattatggttgacaagataaactactttaactatcaaaagatagccatgtacacttgttttcacccactgaaatagttcagagtgcttgacatttagattaactgcacactttggagcagcaaccattgaagccagaacaatatctttgaagagaagttactgccactcaagataagttgctttttaaatagaagataaccagaaattctgctatccagtaacaagaagagaatagcagagaccattcatactaaatgagaaagacatgaataaatatatattctgtttaatttcacaatcataagcatggtattaggagctttggagaaagctgttttaggagctctaaagaaagctctattcttgccttctagaactcctactggatgtatattgagcttttctatttttttttctttgaagtactcgtatatatgtaagcactctttatctttctggtactatctgaatgattttctcagatctgttttccagtttaatggtactctctataattgtgtctactataccatttaaacaatccaatgagattttaatttcaatgactacatttttcctatgtacagacattctacttttgtcaaaatcgcctcttattttttcatagtgtctaattcttaggtttttaatttttttttttttttttttggtccttaatcattctgaacatgcttacaattttatctgacagatacacttaccccaagtttggggaagacaaattgctgctttttgttttgtctgtagactgtagctgaaggtagattgtttcctcttaaattttgtagtttgtgaactcactgaaagcaaggttcggtcttagaaatcctttgtgacttggtttgagagtatattcttttaaaaacggtttgcggccgggcgcagtggctcacgcctgtaatcccagcactttgggaggccgaggtgggcagatcacttgaggtcaggaatttgagaccagcctggccaacatggtgaaaccccatctctactaaaaatacaaaaaattagctgggcttggtggtgtgcgcctgtaatcacagctacttgggaggctgaggcaggagaatcgcttgtacccgggaggcagaaggaggtttcagtgagccgagatcgcaccgctgcacgccagcctgggcaaccaagcaagactctgtctcaaacaaaaacaaaaacaaaaaacgtttgatttgcttctgccgggtgcctcaggcagaagcattgctgacccaagaccacttttaatattaatttcttggcttggggttccagaaccataatgatagtttaagtttcaatctaatattccaatcccagggaggcccaggctagtgggtaaaattttcctatcaggaaaaaacaagttgtttaagacaacataggagatttcttattgttccctttgcagtgagaaaatttttaaagtttcctctttgaatgagggcgtgacacttcaagggtccaggcgttatctaggagtctcagtaacagttgagacctacctagtcttctccttgttcattaaaaaggttacagagggctgggcatgttgattcacgcctgtaaccccagcacttttggaggctgaggtgggaggaacacttgagcccgggagttctagatcagcctgggcaacatagtgaaaacctgtgtctacaaacaatacaaaaattatccaggtttggtggcacatgcccagcaatagagcgagaccctgtctcaaaaaaaaaaaaaaaaaaaaaaagaaaaagaaaaaggtgggccaagtgcaatggctcacgcctataatcccaacactttggggggctgaggcaggtggatcacgagatgaagagatcaagaccatcctggccaacatggtgaaaccccatctctaaaaatacaaaacttagctgggcgtggtggtgcacacttgtattcccaactactcggggggcaggagaatcacttgaacctcagaggcggaggttgcagtcagctgagattgcaccactgcactccagcctggagacagagcgagactccgtctcaaaagaaaaaaaaaaacaaaaaaccagaaaaaagaaaaagattacagaaactggcagacctcctcaggaaagctatgccagcttacctgcactttacgttttttctcttccctctgcttttggcttattctttctttccaattcagtcaattaacccaaagtgtaagttccacaggcaggctgagattgttggctttttgttcatggatataacttcagtgcctagaacagagcctggcataaagtaaacactcaagagatgctaaatgaattcatccaaaaggtagtatatttaacccaacaattctaggtgttttatatagcaaggaagttggcagttaggtaatctaggttgccgcattgtctgaaatagaaagtacagtagaatctaaaaaaagagagagaaagagagagagaacgtgaagatttagattcagactttgattatttcttctaatcctcaaagcatgaccctaaagatactaaaccaaattctcactaacccagtaagtacagtgaatcacttcatctgtgttcatctgagtaataccttctaggcagtttaagtctttcttttgtatccttttatttatcaccagggcatttcatactcagtgtctttttataaatagttttacaatcaattgatgatgaaggtcttaagaacaatagtgtttacttatattgcatcataacaatgttcaaaacacattttgaaatttcatttgatttacaggcaactatctgacagatatttacggtggtgaaaatttttacacagtactgtattttaaccaagggcttacagaggtatttaaatggaaaactcactttgaaacactgggcttgtgtgagaattctagaaaaaataatgaactacaggaactggtttatgtgaaagtgattttctgagtaaaatgaggtctttcttttccaatttttattatgccattttaggtggttatattattaatagaatatttgaggggctggattggaaaacgaaaggaaaagaaaacccctgaatatctgtttttgttttccgatgagcttcacagactttgtgatatgagtataagcacctatttccttaactcaaattttctccatttataagaaaaattattgccacctaatttttttccttcagagggaaataatgactactaaatgtctgcaatgtgtgtgagattttctggacaaaagaggcattttaatggtaatttactgttttcagtgtcataaaaatgttgaatttataataccacctttcttttcttctttttttttttttttttacatctgcaacagatttatttttaaaggaatggattataataccacctttctaatagctcctgaaatgtaaccagatcagggaagtgttgttacctgaagttacctaactttagaaaatcaaggagaagcagtttctggaaagccacagagttagtcgataatgaaataagagattaagctacaccaaggattagattggtattttcaaaatcaaaaaccaactctcgttttgtccttgtacacttggaagatccacctgaggctctggccactgtagttaaaattcacatgatggagccgggcatggtggcccacacctgtaatcctagcgctttgggaggccaaggtgggtggatcacctgaggtgaggagttcaagaccaaccaggccagcatggtgaaaccccgtttctactaaaaatataaaaaattcactgggcgtgttggcgcacgcctgtaatctcaactacttgggaggctgaggcaggagaatcacttgacggaggttgcagtgagctgagattgtgccactgcactccagcctgggccacagagcaagactgtgtcaaaaaaaaaatcatatgatagtaaaatatacaaaaacaaaaagttttatacaatttgttttgatgacttgtttttaagaaagaggtcaattttgaagaagacttaagttttgtttgagacgagagaaagtaaagatatagccaggaagtgaggtgaaaacgaattttaggacacagaaatgaagactttaattccatcctttgcaaatcatccataaatatgtttggcttcttttaaatgttcgtcaagttcaacaattgaaaaggaactgacagaatttggtttagtatctttagggtcatcctttgagcattagaagaaataatcaaagactgaatctaaatcttcacattctctttttgtctttgagagtccagtgtactttctgttttaggcaatgtggcaacctagattacctgacaactcccttgctatataaaacaatatgtgtatcatattgcaagctcttaagagggctaaggccagagggttttcatttattccacttgctatcattattattcaggagtaaggaagccacatgctgatgaatgaatacccaggaggtgttttgtgtaacggtgcttctcagattctctcacagttttgtgaaattaaaactgtttctgtctctctgtctgtctgtctgtctccctccacctccacccagtttctgcctgtccctctctgtcctttcttcttccgtccctccatcttcctttctccatcccttcctgactccatttgtcttttgatgactgactttactcaaactactcgtattctgaagcagcacagctgtccgcccttagcttctatctcccttccagattagggtatttgttccctggggacgtgtgtagccaggccacatggagatccagggaaggaggggaaggagaacagggtgaaggaagtgggtgggacagagcagttggagtcgctgcagtgacacctttccaactgtgcacacctgctgaaagcgaatgccagcccactctcctcctttcctctcatctcacactcaccttttacttcctcccacatgaaccgagcacacacatacaaatgcagacatatactcacaccaagatattttcatctcacagcaggtattattttcttccccagttttcctgtctcaaagtccatttccactctgctccctgaagaccacagcccaaggctgtaaaccagggaggagctggagctgagttgcacatggcagcctgggagctgccagcagtagcttttagtcttaaaaaaaaaaaaaagaagccagcaaataagcccagatatgcattgttttgttttgtttcttcttggcatgatcctgtggccatactagctaggaaaaggtgactaggccgaacttcatgactatgagatcaaattccttcctgtgtgagaactggcaagaggttagtttgttttctgttcttatgacatttcctttttgcatatttttgatttttattttttttagaggcagggtcttgctgtgttgctcaatctggtctggactcacacaatcttcctgcctcaacctccccaagtgataggattacaggcgtgaaccactgagcctggccctatgacatttctgatcgtaatttttctacctgttaaagcaaacacttttttgtctctacaaaaaatttaaaaattagctgggcatggtggcacacatctgtcccaggtactcaggaagctgaggcaggaggaccagttgagcccagaagtctgaagctgtggtgagctctgatcacaccactgcacttcagcctgggcaacacagcaagacctgtctctaaataaatcaataaagtgaacacatttcctctccaggcgtatttgcttgtgtgttctcacttctggtgatggtgctattagttgctgacaaggcttttctgttactttgtttttcctcatgatgttctgccctttatttcttccctgttttttgttttggtgtgtgtgtgtgtgtgtgtgtgtgtgtgtgtgtgtgtgtgtgtgtgttttcccgagatggagtcttgctctgttacccagactggagtgcagtggcgtgatctcagctcactgcaacctccgcctcctgggttcatgcaattctcctgcctcagcctcccaagtagctaggattacaggcacgtgccaccgcgcccagctaatttttgtattcagtagaggtggggtttcaccatgttggccaggctggtctcgaactcctgacctcatgatctgcccacctcagcctcccaaagtgttgggattacaggtgtaagccagtgcacccagtctcttccctgttcttggcacttaacttttatgtcaggcactgtgtgtttttagctcctttaaacaagcactatcaaataagtgaggctcagagagattaagtaatttatgcaagaaaatatcccacggaaagtaaatatgccatattcattgtcatgtgtctcaatggcgcctctcaccatgctgattcataataacagagttgctatctagggaaagtcaccagcagtttttcttcttctccatgcagagttccatgaataggccttacatttgcttggaactgggggccggtaagctgcttacactgtaatctaccctgtatccaatagctcgtagcattttcctggtataatagtcaacatactttattcagtgtacaccatgatccaggttcttaacccatgccagcaggtctaacatgggaacagaatgccttaagtgacgctgttgaagagctaagggaggagcagggtgaccgcagtctttattatctaatctctatgattaatgtgagttttaaaaaacatctgatattaatttcattcaacatagtgaataaaaacatgcaactgttaggctttcattgaagttatatgagcagtgggaccttgataaaggaaaggcacgtggaaagaaagagtaaatttaataaagacgctgtttgggtatgatgcataatttctcataaccatggtaccgagaatttaattttcagaaagatagagaggaatattttgaaaaaataattgataccttttctaaaatatctaagagcattgctaatcataagctttaaaatattaataaaaggaaaacatactgtgtttggtaaaatataatttataataatttttaaatattattttatagctttcattttatatattatatattttatatgatctttatattattcacatatctttaaaggtagattttaaatatcagaacattttcaaagaaatattcctaaactccagtctttggggtgagtggcatggttccttgcttgaatgagatgaccccacaaggtgctattatataaatgtcatcaatcaatcagcacatttttgggagtccttgaagtacgtgcttagtgaaagtaccagaagatccaaaaaaatttgagttagaatccttgcctttcaggatctaagagttaagttggggaaatacaacatatttgcaaattaccttatagttaaaggcagtatggacaagctcaactttttactacttccacactctctcattgaattcttcacaaatagtcattcattcaacaagtatttattgagtgtctgcccttgtgaggtccatagagctcaaaggtgaatcgcatgtgaatcctgcccgtagggagctgagcaggggacatgagccctacaaccttaactctagcacagaggggaatgcgaatagagccatgaaaaagggacagatacaataaggtgactccgaagaaagatcaatgatttttacctggagaaaacagaggtggcatcaccttttttagatcttaaagtaatttggatttggagatagaaagatggaggaaaatgtctttccagagagaagcaactctgcctaagtagaaaggtgtaaggcatggagtggctacagcaagcgtggctagagcaaggaatatgcgaagaggacacacgagggagagcttgcaaaaatatattttggggtatctgtgaccaaatataacattcacctttagagttcatttcaagtttgataggcactagaaagccatttggagttttctaggagtaaatcgacatgttcagaggtatgttgcagtaacattaaacctggtgactatgtgaggtctgattgtcccatctgtaactcactcaaagtcattatatccagaacttttttatcaatctgtgtatcagtgaatttgtctaaagtgaaaggctgcagtggctgttctggttgttcttgtgcggatctgcccagctgtgttagatccttaaacacttttatagtctccaagtctagaccctgtcctttttccttgtgtccattttgaaccttggtcacaaagatttccctgggtattcaattgttctttatgcaaagacttaaaaagagccaggtacagatcctcacacctgcagtctcagtactttgggaggcctccgcgggaggatcgcttgagcccaggagttcaagactggcctgggcaacatagggaaaccccatctcgacaaaattatattttaaaaaaattagccgggcgtggtggcacatgcctgtagtttcagctacttgagaggctgaggcaggaggatcacttgagcatgggaggtagacgctgcagtgagctgtagtcataccactgcactccagcccagagaacagagcaagaccttgtctcagaggaagaaaaaaacaaacttaaaaagaaatgttatctctattttcagtaacagaaataaaatgaaaaatagtaatgtttttcataagcaacctttcgatcttaaaaatactctaaatcatgcaactgattatgtttccctctttgtgctggcaagtagattatttaaagccagatttgtgttcctctttaaaaatgtatagtactatacagtaggtattttgtccactaaccttaaatctggctttatcttatgtttcacacttttatttttcttgtattctatctttatttttggcagtgttgtactttatcttgttacactttatatactgattctatcttgagtaaattggtacggataaatacatgctccagccacttctcatgttttgtaagcccaaatctgtagagctagcattgaccctaactgaatccccggattttgctcctgtttgtggtctggtgcagaatttaaatttctgtccaggccaggcacagtggctcatgcctgtaatcccagcaccttcagaggccaaggctggaggctcacttgagctctggagttcgagaccagtctgggcaacatagtgagaccttgtctctacaaaaaatttaaaaattagccagtgaggtggctcatgcctgtgatcccagctactcaggaggctgaggtgggattgattttcttgagtccgggaggtcaaggctgcagtgagctgtgattgtgccactgcaccccagcctgggcaacagagcgagaccctgtctcaaaaaacaattaaaaaaattttttttaaatttccggccatccaccctatatcattcagactttgcatgtattctgttccaccaaattttagattgaacctagctttcatcagctggatttgttttattggtaggcctcctgattgtgttgtcaattcaagaggttccagtaaacagcacactgctgcactagcctgggcagaccattggcaagagcatggatcctcgtgtggtgtcttgtacgctgtaagttctcagcagacacttacaaaatgaagacgtgtacctaaggaaagcagcagctgcttatttttgaaaccttaatggaagttttcccaatggttacgtttttatttaggaataagaattctaaattcaacatattgaaacatgatgataatggatcttaaaatcatttctctttcagtaacagtgttcttgtccataatgctttattttaccatttacacagagctttcatccgtgactgacgtagcagattcctggaatatcaagtctagaaaatgtacttgggatgaatggctaagtgtgtgatgaataaatgaatgagtgggtgcatttcactgaatccttacaattgcactaagacctggatggggcaatagtatttctcacattacaggtgagaaaactgaggcttactatcatgatgtctgacagaatcaggacttaaatttgttactatgacttgtaatattctgctcttcacatagtataatatctaacataatttcttctctataatataatattctttcatggcatcatggagtcatctgacccataccactgcttctttttaggcaaagtcttgttactttttccttggaaacatttctccctgttctctctttgtttctattctgttgacaccaacctagtctaggccctcataactatagcttgtttagtcatgctatcagcaatttcttgaaatgtaccttaaagacatccatagagattctagtcacatacactgatgctctaataaattatatgaaacctgaataataaatctttcatgaattttaaactgttagtttctctttttctaacacaatgacaactgtatgtgccatttcctcaaaagcgtatttcagtctgagatttagacaatcataatttttcatgaacaccaaagcaataaaccaagaaggattcctgcagtttctggtatgggaaatttcaagaagacagagtttctatttttgaagttcccccatatcagaaactgcaaggaagtagcgatattttcatatatttaggtattatctctatccctcattacaagagtgagaaattattcattgttaaattatatgatatggaatattagggatcattagaaacatgtaatattactgatgttatatgctatgagaggagttatttttatcattgtaccctgtaaagaggtttgataatatatattaaaacaattacatattatgtattcatttcatgcaaactgaattacaatgttaaactgtgctatttggcttaacaatcactgctggagttcacatcgtagatggaagctagtacttgtgtttcctattctttgttaatatgtgcatttatattaatagcatgatttaatacatcactttaaaattatactgcattttgaactgcatttagtccaaaattgacatcttatgtgtgtggaaccatatcagtttagcattaaattaaagagtcatctatctgtttggtaaaatgtagtcttcgtaaattctagcacatccaaagctaggtaatgagatggaaagtaggtctcagatgttacattaatttgtgaattttaacttatgacgtattagctttacggaattttctagcagttacaacacagcattcaaaacacagtatttatgttttgaagttgtcagactctttatgattctggtttaaaacaaaaatatttgtatcactgacatagtggcatgagcctatctggtcacctatgacttacttcagaatgtagttacactgcttactgtgaaattggaaaatctgttctgtgtgtgttctaatggatgtgacggtcattaagtatatgagtcttctgacgttgtaatcagatgtgattcagtctgttaagtacccatgaaacaacatctgcttcacagagtgaccttctgctaaagaatacttagcatctattagtagatcatagtgcagatctgccttatttgaaatgcactaaacaagagtagtctactgctgtttagcaactagcttgtaataatttattgcagttaaataaagcttaaaaaaactccattaaataattatagggattatatgcattttgaaaacctttgtgttctactgaaattacccatttaatttcagggttggtttgttaaaaaaagctgaaatctgaaggcacattagaggagctgtcagatgctgttttctgtaggtgttaataaaaccagatgaaaaaaaaatctgaaacaaattaaaaccaaaagcaattttgccatctgttgtgtattaattagaactttgtgtatcaagggtaaacttgctcttagagaatgtcactgaacacccacttaatagaataatatgcaaatttattaggttatggatttatatgcagtttttaattctaattcatctgcagtggatccccaagaaattggtagtgtgtatatacatatatatatatataatgagttctctttctttttttttttttttttttttttcagagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggtaacatctaaaatttcaaaataagctagcccaacccttttctcaccaggagcaatttactatacttacatattctggtgtggtgttttggggttttgttgttgttgtgttttcttttttcttctctaagaagcagttccagattgttgtgatttttttagttgctgggtcagtgaatgtgcctattcttttcacacagtttgttgcctacaagagatgagaataaattacttcagtgaaactttcccttaccactgtttgtttttttcttatctacaaattatcaggcatgtggagaaaaggacagagatgtaaaatgttattctcagttgcatgtagtttgattcagtggacatgtctggcatcttcttggttctagacctctgtactttctcagactatattttgttcattacatcatatattcatagtggagccccactatgaatataacacttaagcacaaatcagatgacagtttgttaaggatattgtagtttcttgcagtatgagggagataggacctactctctaaagttccttgcaggattatttcctaagacaatccattcatcctgacacagttctattaggaagtttttccctacaatgaactgaaatctccatccctgaaacttccatcctctgactgtaaccgtacaactagtagtctgcaactatacaaaacaattttgccctgattcatacatgatggcccatgagcttctcagtcttctagaggcttcagcagtttaatggtccttctctgtacacatagcatagtgtttcattaaggttcaaagttaggacttctcgcaaaggctggctgacaagtggtaaactgctcatacaaaagtatgatcagcgaaagctgttttgagctaatccatttcattattcaggatctcctggcatataaaatttcgccttctttctttggacaggagcgtaacagtcactgtctccttgtaattatgtattgcacaaccaacagtggtgtcttaccttattggtcttctgttggcagctttgcggggaggttcccccaacattcctcttattctttatttcttctctgccccagggtttccgttaggcttggagaaaaagagttatcaccatagaaaagccagaaaatagagagctcttgacgccttgagagactgtcccccaaaatgtcctgccctagagcttccggttaacattaggatttaaattagcttctgggtgaacaaagtgtctcacaatgaatacattgctatttctcaccattaggtatatggtctcaacccattctgccttgaggatgagctagcaggaggtccccacagttagttgtcaacaatgaaagtctttctgtgttttcttttactcttgacctaagaacaaggttctaaagaactcttatctttttatccatatcagccacgagtagttgagttttattgtttattttgtattattgaacattcttctgggagaaattaggaagagaaagaacaggaaaaataggcaaacagcagatttctcttcacttaagacacagtcatgtatacggatttttttttcctgaggttattagcacagacgtaaatttacccagtgtaattaattagcacacactgaacagctaatcaacaccgattcactattgtcatttggaaaaaatttattaggaaaaaagtaattttccagttgagtcatcagattgaatatggatattacattgtagttgacaataattgttttgacaaatatttatgaaatatgtcaaattaaatcctcagaaacgtgtttaattttagtgatgttataaaacacaaaagcctcaaaaactgtcagtaggagagttagcattccgtgaaaccatgtcttccagtgaatttggaataattttgagaagagtaagatgcgttcttgttattcgtcttattgcactggaaattttgattgatgagactttaaagaaagaaagtagttggttagaagaaaatccactgtagccatatgtgaaattgtagctggtttctctatattcagaccatataagaaatcactcccatggtgagtagttactgagattttcttccatttcaaagtaatgccattaatgaatcatcaatggaattaatattatacagttttatgagtttcagggaggaaatcaaccgctgatatgatctcactaataaatatacagaataattaatctaaaaatttgttgttacactaacaaattttaatctgcagtatagttttgttgttttctcgttatccaaagttcacatcttacagtgtcgctaatcaaaagaaatgatatttcaacttgcagtactcagtgagtgaagctaagcagtgatgtgaaaatctcacactgtaccgacacagtactactgtggtttctttaatagtctcacttggttggaactctggaggtgaagaaccagtcttatttatcattgatttttccttcttttagttaaggttccctattgagtatgattctcagactcagtttcagctatattaacaactttatccagacttgtgtctgcctttaactattttttaatctagtgtattgtttcatctttggcaattatttatatatatatatatatatacacacacacaccgattttgctaattctcactttttctgaaactgccacttaaaggttataagctatgaagtttaaaattcagttacgaataaataagaatctctatatttttctcttagttcctcccccttttctcttttcagcacaaattgatagtaattggttacaaaatggcatgtaataacccttgaaaatctcagtgatttgtagacttacagtttatgtgaattgctggaaaaggcataaaaggattttctactttgtcctatatgtttcagtatagctatcattttgatttattcaaaagcattctttttcaccaggcagtttcttgcttccataaaaatgtttatttcctttctctaatgaatttaacatttgctcctgctggagacaatcaatgtgactgtgtactgtacattcccactcagtgaatagaatacttctggtctataatctccagtgactttcagatctcctagagtcacactgagatccaaaaatgcctttgcagttcataagcatctccttattatgtcatcatttcctattaacaatcggtccctatgtataataccaagtgcttgcttacaattttcctgaaaattccttttctttgagctcactatttgttatactttggattattcacttttagggcattggagagcctatagcttgccctttgtttattttatacttcagctgcttcagtatgtaataatagctgctacaagaatacagagcagctgagcaaacgcttagaattggcccagtacagcagcagcacttaaaggtatggtacagtaactctcattgagaagccttgtccttcagcaactgtaaagttaattgcctgcaagttcctcatttatatacgtgaattaaacagcttagtagttacctattagatgttaacaaaacggttcatttgtagccatttaataaaagatttattaaagtcttgttttattatgaagcctactttggcatggatagttcattagttatgttcccatagctttttaccttctagttcagtaatgctttgctaattattaatgtatgaaattgcatattaaattgcctctttattagtgcattttttatttcaatattgagatgtcttgagccgcattaatgtgagatcaattgttaacgtcgttaaaaaaacagaatacctaaacagagatattgtttactaaactaagatatgatacttttttctctttttatcttctttaaaatggttgtagggaaggtaaaaacagtcatacacacaccgggtctgagtcagccttgctgacgtgtgtctgcatcctatatggggtagctttcctgccccagaggaaacctttcccagctgaagaattaacctccacccacttactgataactaataaactaccattagtgaggtagtaagtagtggaatcctccgtaattaaagatacaacttcaagtaaaatatgcctgggaaggtagctcgatgactaaggttgactgactgatgctgatgccatatgcttttgttaaagacagcttggggagacacagggtacctgtggggaaaaggaatattactgaatatggaaaagaggtccaaaaatgaagaacctaaggttacttaacaaaaatttcaaaattggacctgggccaatggtaggaaattcttaaagtttcaccatcatcatttatttaaaaaaaaaaaaaaaagggaaagtcaacttaaattatatactaatgaatagtaaaaaatcacttggattctaagtctcttaaaatatggcaccttttataacttagtatttcttaagaggactaggaagggatattgtttatttgtgagaatgggaagaaacatgaagagggagatataaagttcaagaatttgctgtgtgctgttaatatttaaggcctatttcaagccctggctaaaaaaacctttgtctcagagagaggaggataattgaggaagctattgtaagcttaattcagtgcctaagctctgtggtgaccatatagttcattactaaagccaggacacttgcagagtgagaaggggccatatcaacagttaccctggaattgcagcataaactgatagctgtaccaggcaaagagggacgtgtgattaccacactaagttttatttccaagagtaaagttaattttaagtccaaattttcttatgccttagataaataagaataagaaatcaaacgagaaaggcaggttgaatgcaggtaaggctccagacttgaacatttctaatagtttctattgctaacttagagcaaatatttaaacttttattgacccccttcgcagaaaaagcttctattggcctccaaaatatgtagctcctaaaataatacttaaaatatttgtcttaattttcttctcagagtttcaagagaacacttatcacaatatcaagagaacaagaggtagcaggccgggcgtggtggctcacgcctgtaatcccagcactttgggaggccgaggcgggtggatcacctgaggtcaggagtttgagaccagcctggccaacatggtgaaaccccgtctctacgaaaaatacaaaaattagccaggcggggtggtgggcacctgtaatctcagctacttggcaggctgaggtgagagaatctcttgaacccgggaggcagtggttgcagtgagccaagatctcaccactgcactccagcctgggcgacagagggagactctgtctcaaaaaaaaaaaaaaaaaaaaaaaaaggtagcgtatataaaatatggtcctgaatttactcaaagaataaacatctctgtgtctccagcagcattacagtttgggtttccaaaaccattctctcaggctgaagtagaggcttcattctaggaaagtttgagataaagtttcaaagatggttattaagataagtgagagtaaaagccctattttttaatgtgagattattattaaccacttgtaatgctgtagcctcaacttgattgtttagtgggcgtcacgccaataattaaaatgtgaaagaaggttctagaccaatagcagctctcaaatgaaggtcattctcaggagtcagtattgatatatattctaattaaaacctggtggatatagtagggatacaaatcacagtttagcgtcatgagaaaagcatatgctttagagacctggtttgtaatcctgcatccaccattttcactaactatttaaatgtgaggtcacatatttaaatgtgaagtcagtttccaatgcaataataatacctactcaaaatgatttataagtgtgaaatgaaataaagtaagtggagcacgtggcacatgctaggtgttccgtaaatgtttttaaaataattaccaaatggtaatagcagccattgtgaagggcacctcattggttaatacctttcatcataaagtagctctcatctctccaaacaataagaaaagcatttgtcttaactgagatatttttgtctaatttatctttatgtgttaggtaggctaaacatgaaattaaaccatggttaattttactagattaaaatctcttagttttctcactcttcccgtcgcttaacaaaaagtaggtggatttttgtaggtaggaacgcccagactgttaattttgttcttgagaagaaaaaaaatcttcaaataataatgaaaggcaactattcatatccttgaaacatttaattaactaaagtaataaatgtttggaatgaatcaataaaagccttcatagatgcattgtcttcacatcactcagaagtgagaccccagttttatttaaggtattgaacgctttagagtcttttgtgcatgataaaagtactgtacaatagagtgggagtgttattttgtttaattggagtgaaccagtttctttttaatagcaattaagacaccaagaaagtatgcattaatcatttgctatagtccttaagtgatattgaaagcgtaatttcaataaattgcagatactgtatattctgataatgtttggctttggataaccgtaatctatataaaatgttcacacatgatcatcttaattttcatggtacctgtagaaatgaattgttaattacttctaacacattttgaatcacacttttttgaacgtgaacagtgtaaaaggtaatctgtgcctttactctggtcctagtcagtgattgcgattaagccattatcttcatctgaaaatgacctgtcattctcaagcacttctcttcctctcgagcaactgttttgtgaggctttttaaaaataccattcactagtattgtctgtaaaagtatgtctcagtcctctttacttgtgtatgtgtatgtatttgtacataagtatgcatacatattttatgtctacttgacatccttgctacctggtgattttattttttcctggaatcaaggtgtattcagtttttttaaagattgattgattgattgattgatatttttttgagacggggccttgctctgtcactcatgctagagtgcattggcacaatcacggctcccagcagtcttgacctcccatctctggttcaagcaatccttctgcctcagcctcctgagtagcatggactacaggtgtggcatggtgcccagataatttcttaatatttaattattagcatttatttatttgtctaccggctgcttggcgtttattttccacgaggtgcaaggtgaaaagttacaggtgtcaggagagctcacgtgcgctgggacagtgaggagggctgtctcctttttggtgttagctgtgttgatgtaaaagagcgccctgctcgtccgcttgctgcagccgcccggtctgcagggtccgcggcggcggggagggattctggcgtcctagcgcttctgcaggcccgggtttgggggtggccgctcaggtcagggctaggacccagcactggctttgctggacaggccatcggactgcctcctgggaggtccccaagccaggccacaggcggtcctgctgcaggggtcctaggaggccccgggtgctctgcggaccataaaaataccatggccatgaaaggagctcgcccgccagtgacctgggtcagccaggggctcaggggcggcttccctatggcactcggtgccgccgcaggagctgctgttggaagtggaacctactgtaggtagtagtcgtgggtggccccaagcaagaggctggagggactggagggtatggcccatgctcttgcttgcaggctggtgggacctcagtggcaactcttggggatgggactggggacgctaggccaggaaccatttgcggaggagcctgctgggaggctactccatgatggaaacgtgcacagattaattttttagttttttaaatttttgtagagactgggtctgctatgcagtctacccacctgggcctcccaaagtgctggtattacaggcgtgagccaccacacccagccttaattttaaaactgtgtttttctctggaatttcattctctggtttcatcaccaattaatatacaccctgtcaaagataattgcatatctttttctgcattcctttattttttcctggacaggcttttgcctactttcttctccactaatttcaaacctgaggtaaagtctgttttctattacaccagtctgagaactctttcttcttataccataagattaaattcttggacatgcaattaaccaactaaacttaatcaattctatttgataacccctctgattctgctgtaaccttctttgtgctttcgtagcatctcacttcatattctgaaccacttgaaatactgctaccagaaattgttccagttacatctcacagtaatataatattgctaccgtctggtcatggtgtgtggaaagaagcattggtttggggataggaggatctggattaaaatctcaacatcctactagctgtgtaaccttggtcagggtaattacacattcttatcttgtgtttccataaaatgggattgtaatacttcacaacgactttataagggttccttaagatgtcatgtgaagtacctaatgcttcagtttctttgctttttattcttttcttaggctatgtgtttaaaggaaaaataattcatttaataactacaaaggtaaattgacatctaccaaggaaataaagatgtgataaaatgcagtgacagctaccaagaacttacatgttaattaatttttgtgacaattaggtagctttttacctttgcagattttttgacagtaagaataatcactaaatcctcaacttaattgacttcctaacagagataaactatgaagtaaatatttaaaaagagaatttgttttagaaaaaacaaataactgtgataatatgtaacagtgataatatgggaaagaaattctctgagatagtggtgtcttagagataattcataaaatgaagcctgaatgcattcattcatttatgcaggaaatattggttagtcttacagtgtaccagtatgaaaaactcaagaaaggacctgcagatgttttgcctgcttttgagaaagatagattctattccagagcaaatttaaaatcataaagattatctaatctggccaagtgtggtggctcatgcctgtaatcccagcactttgggaggctgaggcaggtggatcacttaaggccaggagttcaaggtcaccctgggcagcatggtgagaccccacctctgacaaaaaaataaaaaccttaaccaggtttggtagcatgtgcctatagccctagctattcgggaagctgaagcaggaggatcacttgagctcaggagctccaggctgcaatgagctatgatcgcaccactgtcctccagcctgggcaacaaagtgagaccctctctctatttttttctcccaaagagctgggattataggtgtgtgccaccatgcccaactaaagttactttttttttttttttttgaggtagggtcttactctgtttctcaggctggaatgcagtggtatgatcacagctcactacaaccttgacctcctgggctcaagcaatcctcccgcctcagcctcccgagtagctgagaccataggagcatgtcaccatgcccagctaatttttttttttttttggagagacagggtgtctcattatgttgaacaggctggtctcaaactcctaggctcatgtgatgctctcacctcagcctcccaaattgttgtgattataggcatgagccatcacatctggccttatcttctttttaaggcccattgagatttagtaattggcctgaggtcacatgactagttagtggcaatactcagctagatgacaggtctccaaatataagttcattaccttttcttctagtaatgatctccaaaaaattttttattacatttgacaggaaaaaaacaaaacctcaacccccaaatatgtgtatttattaaattttaaattaggcacatgcagcaatttactaagcttgtgcctgttatcatacacagattaagaattgaaaggatgaactaaaacaattttacagaattttattttatttctacttattcatctaatgatgtatttaattattaaatatatatttataatagttaaatataagtgaactttatgtattaaatactaatcataccatatttttcaattctaacatttatataaacatttgtgttgaaatttggttaatttctctgatgtctactctgatcatctggcaagctaatcagtagctattacatttttacattttaagtaaataagaacaaaacccactaaaatatgagttagcagacctttaagcagtttagaaaataaaaaattgctatagatgacatacatttattttgcagcaaagtcatatattgatgggactatttccaaatgtaaattttcaaaatattctctcagaactaataatttctttagagaagctatactgtctttatcattcttgaacacttcctctacttggagggacagattattaattttttcaaaaatatattcttgataagatacctttgacagccacttgtcaccattgaacaggtcagcaaaattgaactcttctcctttttgtatatttaattcatctttaaggttaaactctttgggtattttgctgtgagataccttgttaacctttatgtggttaaaaaagattttcaggccaggtgtggtggctcatgcctgaattcccagcattttgggaggtcaaggtgggcagatcacctgaagtcaggagtttgagaccagcctggccaacacggtgaaaccccgtctctactaaaaatacaaaaaaaaattagccgggcgtggtggcggatgcctgtaatctgagctacaggggaggctgaggcaggggaatcacttgaacctgggaggcggaggttgcaatgagccaagattgcaccactgcgctccagcctacgcaacagagcgagactcggtctcaaaaaaaaaaaaaaaaaaattcaagactacaccacaactcatcgcgaaacattgtgcagaatattgtatttacttaaacacacacagagtttcagcagaaagtaaaaggtgacagcatcactgtcaactcctcttctccttttctcaggatcctcaggcattagagaaccttccaacagaaagactgagtataggttccacgatcacccatgcgtaaaatattataaaagcttaatatctttctgatttttagacaggagaaaaatacaagtttgatatgtaattaaatagagtttgaataccttcttatctcactggtttgttttgcatatgagttaaaatgcgtacctgatatagagactgcgtaaatttggaggccagaaagacctggctttgcctgctccttctaacctttgacaagttcagtaagtctcagtttcctcttctttaaaagcagattttataatacacacagacacacacacacacacacacacagtgggaattttgtaaagttaaagtttgataatattttcttggcacatggcaaatagttgttcagtaagcttcactgaagcccttttcactctttgaactgattgttttctgccttgttttgttttgtcatccatttcttgttcactgtcacatacacatcagattagtgacttactagaatgccatgaacaactctcaactcttaccgccggaaattcttttattcttcataaactacttacaaccacccctgaaattcttctcttgatctagcttatacttcctttcttgtgtttatagaaagaactttagtgaacaattctaagcatagatggccatcaataattaaatgaattaataattaaatagatgaagtcttgtccagatagcacataggaattttaacatggtctttttcatttccatttaaattttaatatatttagtgtataataactgccaacaataggtgtaattgatatatgaaaacatgtaagaatataatacaagtttgtacacttgatgacatggattcttcattaaagtaaccaaaatgtgaaacaaagactgtaaagcgattttagtcttcataatggctaaaaatatttttttgtatatttagtcctgttgttcagttcttaacattcccaaacaatacttataatgggatttagtacttggttgtagacctgtctaagttaaagtaagtcgtaatagaaacactttgcttcatattgtagtcctatactttttacatagctgtggttatgcttaaattttatataattctcccgtttacttaagactatgagaagtaagtgtgaaagatagtacagaactcacaaaaatatatttcccccaatcttcttaacactctctagaattttagctcccaattttcagagcttggttaacacacataatgctatacttactatgaacatgttatcatattcattgtaattataaatggatacaaaggcaaatgccaaaatgtataattactaatatattgatattgcacatttttatgtaaaatagtaaaaccagtttttgtctgaaagcatattttgtgcaattactaataggtcatattaattcaggtagcagcagtgaagtgtatcttgtttataagctttgcatttaagacacctttcttgcaggaatcacctcctagtgtgaaagttttccaaagataatagcacatcaattcaaaagtgtaatagatttgagaccacaacatgctatcagcatgaagaagtagtttatcagtctcactaactcacggtgtcacagctagaatcattacatatttgttcttttgttttcccatcaaagtacatagtttacattgtaatgttggttgcttattttcttatttaaagtgtttatttttaaaatgcataccagaattaatttttggtaataatagaagaggcactttagtgggaatctaaaatattttctttttataattgcatagtatacatagtatattacttcctataaaacatttatcattaaatgcatagtattaatacctttatattagaaagaatcaatccattttgaacaaaatggccaatttttagaaaattcacatacatagacatttacttatctgcctttcctagaatcatcctttttaaaagttagcagaaatccagtgattaaaattcaaggaaaaataatgaattttagtttattactgacttactatgagtatgttttattacttattacttcttagctgtgtctttttaatcaagccttgagacaagcctttttattttttaaatcccatttgctcatttttatttttagttatagcttttttgtcaagtataaatctactgccagtggtcgctgaaaaagttaattaaaaaactagtcctcctagtactttttcctttcctcataccacttaattactctttaagttctcctgcacacactctcgaaagcatgttttaaaattatttctaaaggttgaaagaaaacactttctctttaactctaacaatgagaattcaatgtggagtattttttcaattacactggtttttttgctgcctccaacctcagtaagaattcagtttcttcacgttgtttcatagatccgaagctaccattgctgcagcctttttgagagtatggcagggcgtccactgcagccagcactgggagcatcatcttaattgtcactactttgtcctcagcagtttcgaagaagagttagggaaaaggcatgtttctcagaaaaaaaaaaaaaaatacatatatatatatatatatatgtattttttttttcttctccaaatagcagatacgtaaagtgaaaagagattagagattatatttgtgtgtgtgtgtgcttacacgttacatttaaatatttagaattgagtttttcagaagaatctctggtagtaggtaaagagaatgattagaagtagctctttttttaatagaaattttcatacaggtaataagttgaaacaaggcttttagaggaaaaaagaatatataaaaactaccccagccagaaaggttgagagtggagaactagtactctctctgcgaagaaattaatgaagcattttgggaagttgtaaatgcccaaggtaaagtatcaactagatttacacgtggctcagaaatccaagtatagagtcccaagagaaaaggaaagagaaccccttagccaaggtacttgtgaaataaggtgagtgctgatgagtggttttaaagcaaatggaaatgtagatattatgaaacataaagaagacccaaaaggaaatagatgctggtatctcatttggagatgaagtaaaagccagtacacacggtagatacttaaaagtagcaatgacattagcgtaagggaactgattagggaaaacttaactaataggtgaagttgaaagggaagagttaaaaaaagggggatgttgaaaagtgaaaaaaaaaaaagagtgagatgacataaagcaatgaaaaatgtttaagccctttgactctgagatccaatggattgagcgttgtataactcatttgttctaaattgactactcgaagtaagctaccagcagtgactttctaagcaggagtcttgaattgattttctgatttgttatacagtcttgaagggagacttgaagttaaacttaagctaagaaactgatatcctaataccttactgcagtgattctcagagtgtggttcctggagcagccccgtcagttgctggggtttcaccccagacctactgttgtaacaagcccgccaggttactctgatgtaagctaaagtttgaaacctaccgctttaatgtatggaatggtctctcagttgcatttctgctcatgttggtgttctgaccctttaccacagcagttcacaagccctaccaaaaccggcgcttccttatcagtcttgttgaactgttttcgtgtaaaagataggtaactgcgtccatgtgatctcattgttcaattaccacctatgagtgagaatatgcggtgtttggttttttgttcttgcgatagtttactgagaatgatggtcataggaaggggaatatcacactctggggactgtggtggggtggggggagtggggagggatagcattgggagatatacctaatgctagatgacgagttagtgggtgcagcgcaccagcatggcacatgtgtacatatgtaactaacctgcacaatgtgcacatgtaccctaaaacttaaagtataataaaaaaaaaaaaaaaaaggtcaggagatcaagaccatcctggctaacacagtgaaaaaaaaaaaaaaaaagataggtaactgcagaacaccttttgcaagtttctgcagatgctcgtgtgggtgggcttctcccggaagattcccagcagcctctgcagtctttcagttcaggaatcttacagagcttctgagggccagcatcctcggctgatggagaattatttccaaatagctaggcatttgagcagagtgaataattatgctagatatctctggatgtctattgagaatcagttgccagaaggtaaggaaaataaacaggaacccagccttgagtaagaacgggtaattttctatgggggctttttctttagttttctgtttaatagctgccagaaatttcctattcctttcatcattctctaaagcacattatttaaataaactattttttcagcttttaattagtttgaacacattgctaaatatacatttcacagataatccagttggctttggaacttaaaattcagaatttggtagtgaaaatcctaaagattatgataaaaacagattttaagcattcacaatgcgtgggtaatagttaatatcatctttcagataccttatttgtttcaaatacatactgacaaatattttgggctgattctgtgatatttaatgaatgcccaattagagaccacaaggaattaaatgagtaataataggcgttatggaaggtaacacacactaacaattcagtgttatatattttaacagtacttttaaaaatcatcttatcttaaaatgaactctaggcaaaccgtccattgtcttgatatcatcaagtgactaaaactatcttgaactcagtagttaattttagccttcatgtatttccaggtacatttaatccacaagtgtgggattcatttgctttagatctgaaaatgtcattttggaaaagtcgtttgatgttgaggaaatcttgtgagacctttaataagcctcttaaatccagaaagttatattttgctggaaggaagaagaacctataccttaaaatttcctcagctcttaagtgagaacttttggatattgaaaaggttgtaaatttggccaaacatagccagtctttcttattgacacattgtctttgaaatcaaaacatctaatttgaagaaagcaatctatattctagattactttttatcgatttacctacatgtgtcagtagaaagcaggacatcaagggattttatttaatcaggtcacttttagtttaatgtaaatgattctctttgtccaagaaagaatataagaggaggaaagcatcaacatttcctatgcagtagtgcctttgtccctatacgatataatagatgttactacacaagataagtatttttccaggtgtctgtatgtcactaataaaagtttcaacagtgcctcagggacagaagctgagcactaactactacactctctttatcctaattatttgctttgtttgttaatctctaaaaatgtttttaacactatataaaacattgaaggaaacaaactattttctatgaagataactgcttatgaagttaatctaattagaatttatttcattcagtagttacacactttctttttgatttttattttctatgctaatctcccattgaggaaatgactcaaaccacttggaataatgctataacacattttccagggatgcttttcaattgggtccctataatttctaatttattaaactgtattcttgatattaaagataaaatgattatattaatcccctgaacaaaagaccagtattaagacatttttcctagtgactcctataagctttcaatttaattatgtattatgacttatttaattttgttagcatcttctaaaatgaactttgatatattaatattacatatgatatagaaaagtacatttaaatttccttgataatctgattatcttgccactaaaaatcttatgatggtaagttttatgcttattactttgaaagacaaaatcaatcaaaagtgaacagctactaaggaacaaagcatgcctgctaagacatggggtttaaaaaaaaaaaaagcaaaacaaattataagaagcaattgtaagtggcctaagataggagacagaagttttgactgaacaaatagaggtgattcggtatactgtgcgggtccaaaatttaaaacatgatgtttcatttgagggtaaaaaaaaatttgaaatgaaatgttatttttgcctcttctttgcatctgctaagcaggttaaaagaagttgaggtataagaacacagaacttctctgctcagcaataaaagaaaaagaagagaaagaaatgctataaaggaaagactgcaggatcccccaacaggttgactactcgggggtgggggttgggagcaggaaagaagagtaattaaaaattacccaaagtctggcagttagagagacttaaaagacagagttactcaacagtgacctagaaggcagggatggggacagcaaaaaagatgaggaaattcagtcaatttgcaacgtgacccatagaggtatacatcatggaatgggttaaaaataggagctagaaggccaggtgtggtggctcacacctgtaatcgcaacactttgggaggccgaggcaagcggatcacgaggtcaggagatcaagaccatcctggccaacatggtgaaaccctgtctctactaaaaataattaaaaaaaattagctgggcatggtggcacatacctgtagtcccagctacttgggaggctgaggcaggaaaatcgcttgaacctgggaggcagtggttgcggtgagccgagatcacgctactgcactccagcctggcaacagagcaagtctccatctcaaaaaaaaaaacaatagaagctagattagaggtagaagctaacatcaaaaggttactctaaagccagatcaacaaagaaacaaacctttcaacttaagaagacataagagcaactattaattgtgcttaacgtagagtcatccttcctatatatgttttagtttctacatagcattacaagttaatgacgcaatgcagttccaccgttcttgtcttgttgttgttaaatagaatccccctcaagattccagagccacaaagcaactgttagtgttcggtgaccttctgcaccagctgtcttttgggctttgaaattgattttcctcatctcagtctctgatagtctctcttcaagtgtgtctctctagctcatcaccagagtgaaaacagtggcacaaatagctgaggaactggaggcaggctccgtgcagggcatcattggaaacatcagaacaaaaggtgtgctctgtgttaaaaagaagccgccgcggctgctgctttattgctgaatacaatggggaatattctcacaggttcactttttttcattcccaaatatggtctgagaagtaaagaaaatttctgcctttattctacaaacctcatgtggatgccaggtcaaaagcatatgtttttgatagcaatttttgcagaattttttacgtgtgagaagcatattcccagagctgtatgactcggcagagtcacaggatgggaagagactaatgacacacaaaaatgtgtgctttatagagaattaggtgatgataatttccttgtgcggaaactcactgtctactctccatatagccgaatttcagtattccattccttcgttaaatatttgtagagtcctaaacataaagtaaccattgtgttggaccttgagaacgggtaaaaagaagtccttgggcttaaagacacattaatcacaatatgcactttggcagtgtttgatatagtgcaatgaaagagccattgttgcctttggaaagagggtatcctttctgaaccccaaaactaacagagtcctgcgaaatctgagaccaaatattctctgctatagaaaatatactgacatagatcatagtaatgtctaagagatttttacatgtatattttcacatatctattttgaggcctaattttacctgaaggaatccgtctacacaaaatgacaccatttgtttgtaagtagtttcaaaatacatcagtttaaacaatctttactaattctttctttacttacatactagaaagtgatctgaaaatatcaaagactggtgattttattttttgattgattgactgatttttgagacagggtcttgctctgttgcccaggctgcagtacagtggtgcaatcacagctcactgcagcctcaaacttctgggcttaagcattcctcctgcctcaccctcctgagtagctggggctacaggtgcatggcaccatgctaggctaatttttaaaaaagtttttatcacgcctgtaatcccagcactttgggaggccaaggcgggtggatcccctgaggtcaggagatcgagaccatcctggctaacaaagtgaaacctcgtctctactgaaaacacaaaaaattagcaggacatggtggcgggcgcctgtagtcccagccactcgggaggctgaggcaggagaatggcgtgaactcaggaggcagagcttgcagtgaaccgaggtcgcaccactgcactccagcctggacaacagagcgagactccgtctaaaaaaaaaaagatttagtagagatgaggtcccactgtattgcccaggctggtcttgaattcctgggctcaagcaatcctcctgcctcattgttttaaaatatagtgcacaggtgatttggcttctcttcccatgttttatagcatttctgtatttattatgcacgtacatcaccaaggccccagtctgatatacacaatcggattgaaatctcaaaagtacctcttctctgtgactaatctgagtacagtacaggtcccaatctgaggaggggtacttctgagatttaaagtcagtggctggccaggcatggtggctcatgcctgtaatcccagcactttgggaggccaaggcaggaagactgcttaagggtaggagattgaggtcagcctgaacaacatagggagacccccatctgtacaaaaatatatataaatatatatataaaatatataatatataatacatattataatatataatatgtattatatatataaaatatataatatatattatatataaaatatataatatatattatatataaaatatataatatataatatattataatatataataattatatattatatataattatatatataatatataatatatatattatatatatatatattagccagatgtggtggtgcacatgctgtagtccaagctactcaggaggctgaggaagcaggattacttggggctgggaggtcaaggctccagtgagctgtcttcacaccactgtgcaccagcctgagcagctggagtaatgttagaacaaataacaaaatatacaatcacaaagatgtgattttagaatattacatctttgttttgagcaatatctcaaaattacattttcttctaagaaaaataataattgcggcagggcatggtggcccacgcctgtaatcccagcactttgggaggccaaggcgggcagatcacctaggtcaggagttcgagaccagcctggccaacatgatgaaacctcgtctctactaaaaatacagaaattacctggcatggtggcacatgcctttcatcccagctactcaggaggctgaggctcctcccaggaggcggaggttgcagtgagccgagatcacaccacttcactccagcctagatgacaagagcaaaactctatcgcaaaaaaaaagaaaaagaataatttcatagcaactcaagcccttgccaagattggtgatctcatgatctactgatgtctcaagttttggaaatttaaacagaggtgtctgatttgaagtcagcctctatcaaacttactgtctctcacgtagtagatattcacgtttttagtgttgaggctaagttcataatcttgagagtcccataggctcagattcaaatcctatctcccgtggagaaacagcatactttgaataaagctaaaacacacatcccaggcttgctttttggtttttataatttccagccttatttattgctattttatatattatatgatttcattcctttattagctgtggcttcttggccaaggtacttaactttttgaggctcacttttcctcgtctacataatagtcaccattttatttattttacacatatttattgaacacctacaacatgccaagaactttttaagccctgttaatacagaggtgaataggacttcatagagtttacattctaatgggagaagacaaaccatagatgatttgtggagtgaatatatcattcatagtccatcagtatagtacgttagaaatgcaacttttaaaaatatttgtttatgttttttatttttatttttttagacagagtctctttttttttttttctttgagactgagtctcgctccattgcccaggctggagtgcagtggtgtgatctctgctcactgcaagctctgccttccaggttcacgccattctcctgcctcagcctcccgagtagctgggactacaggcgcccaccaccacgcccggctaaattttttttgtatttttagtagagacggggtttcactgtattagccaagatggtctcgatttcctgaccttgtgatccacctgtccccgcctccctaagtgctgggattacaggtgtgagccaccacgtctgaccctatttcttgagacagagtcttactctgtcaccaggctggaatgcagtggtgtagtctcagctcactgcaacctccatctcctgggttcaagcaattctcctgccccagcctccctagcagctgggattacaggcccccgccatcacatctggctaattttttgtattttgtttgtttgtttgtttgtttgtttgtttttactggagacagggtttcagtgtgttggccgggctggtctcgactcctgagcttgtgatccacccgctgcggccttccaaagtgctgggattacaggtgtgagccaccgcacccggcctgttttattttaagcctcattcctagaatcttctcttcaggcagtttgggtccctccctcccttaccccagctcttccatgatgctctgagcacagcagggagcttctggtgttacactcttctccactaagacatctagttttcatgctctctgtcttttcctaatcctcctgatattgcgggggtcgccttcgttcctatccgcgagacccctgcttgtccagtggcacactctgccatctctttgcttctcttgcagccatagaagtaattccgcttcttagaaattatgctcaggcacaggaatctctgcgaggctccctgactgcatcgcctggatgcttcatgcgtttatttctctttgagatcctgttatcacctccgttctctgtctgagatgtaaggcacaggtttcctctgctctcaggccccttggatatacgccgtggtctctgcttctccaggaatcacgcggggaggccaggagcagggccttcatccctgggacatggtatatcttcagccattcttctctttctctcttcctagcccttaataaaatgaaatattttttctagtctaaggggaatctttgttttctaaatatggtttctttctgacattttgggtatatcccaaagcctctctccatttccactttcccccagagggttttcatgggaccaaagactaaggtaagggactacgtcgttggccatgggcctgcaaacctgtcgctacctgagttttgcgtgtttctctacacgcagctttgccaggtagctctctctgctacttctgtcccttcgagcatggcatggaagcagtagaaagagcctcagccttccttggagtcttgccacttccccagaatgccactcacgaagcagaaggcaggcttctctccctgggccctgttgctcctctgctgttaccagctcccctcaggttctccacctgctcccagcgtggacatgttcccctttctggagggaagccctttctcccctcacaccatttttctccccagtccactctatttcactcagcagtctgggctttagaaaaccggtaagagactcaagctatttcttccttcatcttatttcatttctcctggaggcaatgaaataaaactagaatgagaggattgaggcagaggaaacacagaaagggaaaaaagtcaggaggaaaaaacatgctttcaatagtacttcagaaacttgatttaccgcacaaataaataacaagatcactgattgtaataagcactttgaagaaaatgataatacgtggtaatactatggagagtagagggaacagggctttggattgggtggtcaagtagtaacgtctgagctgagatttggaggatgaaggctgaaaatacaaataggcattttattcttcaccgcattatggtgaaaattgtaatgaaacaacaatacagtgcttagtaggtactcaggaaatggcagttatcattattgttgttaatgaagccgacagaatggacacctagctcaggtccatcggtgataccaggaggggtcatccaagactgagctgatgccaaagcccacacttgtagcacgggtccccgaccactgggctgtggaccagtacagatctgcggcctgttaggaactgggccacacagcaggaggtgagtggcagtcgggggagggagcgttactgcctgagctccgcctcctgtcagatcagagatagcattagattctcacaggagcacaaacgctgttgtgaactgcgcatgtgagggatcgaggttgtgcgagaatctaatgcttgatgatctgaggtggaaaagtttcaccccgaaaccatcctccccacccccctattcctggtccagggaaaaattgtcttccacgaaaccggtccctggtgccaaaaacgttggggaccgctgcagtaaagtaagcgaattgtcccacagtcataggaaatgtcagtccttttcctatacttggcaaagatgatcatttggccctgtgaaattcatacaccagtgtttgccaggactttttagggtggaacttccagaagataataataggatgtctgtccaattacatggatctgtccaagcttcacaagaggcatgctttgcaccctttaggctgccttttaaatcctctccagtggcgttgagggaataggctgtttctacgggctgctgagcctcctgctcactcttcatgtataatcctgaaaagagcgagaatctaggtccgggccaacatgattcacaggccagatctagccctgttccttactttttggtactgcttgtgagcagagaatggttttcacatctttaaataattgacagcatgaaaagaaaagatttcatgacatgggaaaattctataaagttaaaatttcaatgtctacaaaaaagtgttattggaacagagccagagttaaacatgtatgcattgtctatggcggctttcacgatagaacagcagagttcagtgatatcgctggaaaagcctaaaatatttactctgtggtcccttacagcaaaagtttgctgatgcctgatctaaatgacatagtccatcttcttatccagactacatgccagtgtgaaatcgccagtatcaaatttgtaaaccagggaattaattttgtacacattcgttttgatgatgttacattttgaattggcatttaaaatcttcaaattatacttttttggtcctttgaatagagactgtgatatgtgattttgagcaaaataataaataactaatgcttattgagcacttaccttgtgctagatactaatgtaaacactttatatatgcattacttcatttaatccttggaaaatgcctgtaaactgtaggtactgttattatgccctttttacagatgataaaaccaagacacaaaacttgagtaacttacccaccatcttgcagctatttataggtgaagtctggctttgaactcagacagtgttgtttcagagcgcttaataaccaggctgaatatggtaggaggtactgatgctgcctccaacatatcacttaattcaggctataaacttttaaattagctttttaaagtagttcagtggggggagatgggctcataatacagtcgctagtataatttgtacaagtggcaactcatcatttgcatctgttctaattttgtgtttgacaaagcattttttagagacattagctctagtctctaaaagctctagttttgcaaccctgttaaaataagtaagtcattagtgccattttttttacaggtcaagaaaaaaaactgaggttccctaggaccacattactaggaaatgatagaccagggactgattttcaatccagaattctttccactctaccgacctgtattaggccaactttcatgacttttaccgtatctgtagaccagcttcactatttttcacgtaatagttttctggagattgattctttgtaacttttaaatacctattcagccttttctaagcaataatatacataaaataaatgagtgtgatccttttttattaattggatacttacataacacttggtatattccaagcactttactttaaatattaactcatttaagtttcataataaccctgtgaggtagatactattaccatcctcattttatacattaagaaaccaaaactgactttcagtaactcgccagggacacatacctactaagtggttaggtggaatttgaaccttggcagtctggcttcccaattctgtcctattagccccttaatttgtttgatatattcagtatttctccaatatacaataagtatatgagtattaaaattagaagtatttagctatgtcttatctaaaatgaccttgcataaagactgtaccatatcagattggaagatctctgtatcttctgaatgtgaaagagagcacagtctgttgacttcattgaatgtattaggaacatcgtaataagtgtcacttactgaatatactgtatattcagtggatactcactgaatatactgtaagtaaccagcataatattaaaagtaaaccatgaaacaaatggtgcttttttaaaatttggagacttctgttgttaataggaatattaaaattagttacctttcctgaagaattccttttacagtgctcttgtcatgtgaccacacaatttctgcttaaacattgtcaaggaagacagcatacaacttttagagacagtttgctctctgttgtatggctcggtggttagggaatgtttccgtatttgatccagaatctgcttcactgaccccttcatttatttaggtttggtgttagaagatgttccatgattccttccctgtccctacccccagcaggttcacactcctgattatgtttgacataagctaacaataaaatagtttgcatcgtttgagaactgagcagctgcctgtaaccgaacttgtttttatagtacttattagcagagaagcaggccaagaggacagtgtttccatggacatccagaaaataaatcagtctgcagaagatccgcgtgatcatgcatactcgtgtttatatgagcgcatagtctcatgagtagtaaatggccatgtagctgggtttcttttgctaactgtgaaaatgctcttagggtaattcatcaagggacattccaaaatggttttgttcaggaaacagtatgattagaaaatctttatagtctctcaagatgtctacttgaagggacagtgatcatttatgatcatttatatgtataaatcctgctatctacattagaaatcagtctctttcattagagtcattattgtgagttagattctttggttaaaacatttccttaatttttaatgttttaggttatataggataaattcttttaaaaaagagagagagagcaaaagagacaggagagctaaatgcatcgctgtctcttgtctcttgtatcgtaacatatttgtatcttataatgatattctccttttccacaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttataggtaagaacaagttcttagaattactttgtctgtaaatcagggtgttacattgttttattacttgtatttattcatttggtctagaaatatattgtgagattatatttggtgggggtgagtttggtaataatgtatcataaatcacagagtattttcagtaattttcagcaaatttagatacatagaaaagcaggttttgtgggtagtgaggtaatattcttggacaaaagctatagggtacatttgtgtttgacttatcccttgtgaaacatggatagctctgtggcatttcatgtacacaaaataattcatgcgcttgcagtaatgaaccctgtgcaggatttccttcaatgcgtactcaatagggagctctccactgcttgtgatattgtaagtctctcagctcactcagccatctaaatgtaaaactcatcactcagggccatcatcttgcactcaggaacactctccagagaactgggcgtccataaagcaatgaatggattatatactcattcatatatgtggatttttcttctcttctgatgtagtattgatcatgtttttcatttgatagtaacccaaataatggaagctactaatagaagttgtaaatattgcttttatttaaccatttcataacatatctgagcattcacactactggaaatcgctttttaaaatgccagaaatgaccacattgtgttttgatcttcttctaagtataggaaaaggcctaccacattgaaatgctaatggtgtccactgagataaatcacaggctttgtggtttatccaccaagaacaatagccagtgatgcatcctcaggtttacaaagcaatttgtgatgccccatgaaattctataactgaataagagtattgcagagctgtatgtagaatactatgatgtttctgcagtggaccagtatcttccactggctacaatactcctgtgatataattatgcactttggaaagtgaaataaccattttgtgtcagtgttcaatgggaaaacagaattgtagagcatgaaggaactttagagacaattgagtcaggaatggcaactacgtgacaagttatacagtattttttccaattttttgaccatggaagacatcattaatgattcacagcactttctctccttaacccgattacatgctgcttatcttcatcagagtgcttcatacagtacctctgacggcctctaccagtcagaggtaaaagcaagatgaaacctttctgttacctttctgtcatcttttaatctaagttaactttctccttataaagacggtcaaaccagatactgaaggggttgtctcttgactaggatcacaccctagtgaaacaatactgctgttgtttcataacagtgaaggtaaatgagtaatttcacaacaaaaatcaatattccagagacagatttctagtattcggttagaaaatgtatcagccatcaagagattctcttctagttagctgtgtatattatttgtacctgtcagaagtgtgctgctaaagaattttaaatggttctgaaagggaccagtcataaatgggatgtaataaattaagaatatgtatttgaactgaacaaggagaacacacgggcacagggaagggaacaagacacactgaggcctgtcatggggttggctgaggggagggagagcattaggtaaaaacagctaatgcatgctggacttaatacctaggtgatgagttgacaggtgcagcaaaaccaccatggcacacatttacctatgtaacaaacctgcacatcctgcacctgcaccctggaacttaaaaataaaaaagaatatgtgtttgttggggattttatttatttatttattttattttattattattattttttttttactaaatggggcacaccaggtagataaatattcagggctggaattcagtgtcaggttgactggtcaggcatcctttctgattgataagtgcctgtgtgcttccagttgttaaatattttgaatatcaattctaatgccatttaattttattttcatggtgtgactagcaggaaaaaatagcattttaatgtgagatcagtcactgttacctgtgagacttgtactctttttaaggacccattagtgaatataactctcagacttctaagtaaaaactcaaaattttcctttttttttcatattgcctagttttactttttagtaattaccaatctgctttattcctactagtaccatggtcataaaccttccctttgcttttatttttccccacatggcaacatgcaaattatctagttaatatactcatgtagggttttcagttcaacagatatttattgaacatttgttttgatctagttattgtgctaggaattaagaagatacaatcccagtgttatctagcaaaaaaattacttttatcttcaaagaattgtctcatacttttatcactttaattaagcacatgtgtgcttccaattttcattggtcttcctatatttaaagggctaacacactaacacaatgattttatttttaatcaggtaaaaaaatttcattcgctcatcagttcgcatggtaaatcttttttgattaaagacgttgcctttacccttgaagaaaagaacaggacacttctctcagggaaggctgtccttttctgttaagtgtgcatgtaaagcagagagggagaaaagaaacacttgcccgtccagccagatcagtctgataaaccccagtatcaatgaggaagaccaatgtcatcatgagattgaccttgcaacctttaacagaaatgcagccttcctgaagcttttttttccattcccttagaattcccttctcttatattgaccgttaatatacagtaaaagcctaagacattaaaaaagagcttgaggaattatttcttcgaatattttttcttaccttccagtaagataatgagaacttacgacaatgtagatttaacatgtctcttctctaaggtaagttgtctcaggatagacaaggtgaacagcttctgaaagagaggcaaggagggagggagggaggtggacaggctttgttgtttattttttctatttcttcaaaatttcagagagtaaagaaagaccttaaaaagtgaaaattaattgtaatcccacagtgcatgctgtcaactttttggtgtgtatccttccagatattgtcccatgtacatatacagctagaggtccatatttttaaatgcattttatactaggcttttctcacatatcattcattatacatcatctatataattttatttagtggctattcttagttaactagttccccaaaatacagtgacttattttcttgtacctgtgtccgtgcatgttggtgtgtgcgtatgtgttcatttgatccagttttttattggtatacattttttgaaggatgtttgctgtaccacagagtaggcatgttttaaattttgaaaaccatggcaactgtcagtttacataaccaccaacgctagtcattacatctatttatctgtctatattttattatgcatatttttaacttttgccaatctcttaggttaaaaggttgttattttgatttattactagtagcgctgactatcttctcatacatttattggccatttgtatttctctttttgtgtgtgaatagcctccacttttctattggggctattctcttttctttttgatttaaaaaggctattttcaattaaggatatgaattttttgtcacatgttatgtacttctccaatttattattaactttggtcagagtcatttttaccatatttcattcacaagttttaaagtcgtcaaatgtatttttccctttatatttctggctttcaagacatacctgtaaagtccttatttaatctaagtgttagtttttatttatttggtatatttttattttttggagacaggttctcactctgtttttttctttaaatttctagctttcatgccatacttatctaatctaagtattagtttttatttatcttttatatttttattttttcaaggcaagatctcactctgtctcacaggctggagtgcaacgacgcagtcacagctcactgcagcctctgcctcctgggctcaagtgatcctcccatctcagcctccctagtagctgggactacaggcacacaccaccatgcccagctaattgtttttatttttttgtagagacaagatctccctatgtttcctagattggtctcaaactcctaggatcaagctgtcctcttgcctcagcctcccaaagtgctgagatgacaggaatgagccaccactgtgcccagccgaggatttttaaaaatgttcttcaacttactctggtacttaatggtttttcagtaactatttttaagttaacattttcttggccactctgatagatgtcagaggtccaaattagctcttcattctagacgctcatagtcaagtgatgaggacgtgcataaaaacactcttaacaccatacatgctttcataccagcttgatgagcaaaaagagaagaaaggcgatacctacgttttgctgtagatttgggggaaagacttgatctggcacctgatgcatgaactggagctttgttcacctcacgccaatggctagtgagaaaatcaccttgagatgaggtcatctgaggaacagcaaggagaaatgcgaaatatctgccatggtgcatgtgcagtgcttactgtgccgggcgctgttctagaaactgtatgaattacctcatttaatttccacaacaaccttaggaggtttcttcttttaacaaatgtaatctgtggcttagagagatggctcgcctgaaggcacacacacaaggactcttacactatactgtctcccgtgaggttttttaagaagtaaaaatagagaagaaattgaagagatttaagcataggagtgaaaaggagtcacatttatgcttttgaaagattgtttcagtggccttccagaacatgcagtatgatgaaaggaggtccagagttgtgctttccaagcattcctgtgcctaggaatcgcctggggaccttgctaagatgcacgtcctgatttagcagatccgaagtgagaaccgagattggtttttccagcaggctctcaggtgatgctgccgtgcttctcagaccacaatatgagtagcacaggtctaggaaatgctgtcacgtgtcccgtttcatgatggaaatgttctgtttccacactgtccaatttagtagccactagacacatgtggctgttgagcacttgaaatgtagctagtaagttgtagaaaccaaagtttaaattgtgctgtttttcattaaactcaaacagcgacatggggctaggaactatcatttggatagtacaagtctagacaacctgttagaaaagtagccataactgggagatcatgaggccctattaggatagaggagcaagcagaattgagaaaccttagctgactcatgatagaataaatgtgatatgatttcacctatcccagtttttaaaaatcaaatgtacatatggtaaactttctttcattggagtcatcttaccattttctttggattactgagcctgcagctaaaatcctgctctaatccattaaccttttgagttgctgtgcctttacgcaacaaaaattctactgatttctaaccacaaatgttaggttcaatgattacagttagtgatacagacctacccaaagaaatacctgttgcacttctctgggccctgatgtactcattcttcttttttgactctgaaattaaaaaaaaaaaaaaaaaaaaaagatgagcagtaaccaccagttgttcaccaaagaatggcaaaaaggagaagagtccatgttctgcgtctgttcaccgttacacgatgggtaggagtcttgatactgttctttgctcacagaaagctcttttttctgggtagaagataacctgaaatgtcaatgttatacacatagaaaaatggccagaaatccctcatgaaggataaacattattgacgcattgctacatgcaaatcataataaatgcttgggatgacgccaattaaactgcaaataagccctcaaatcagacttcaaataacaccgttatagacctttaatttcgtgagcatctctgtgcactgctaggcagagtcagagaatttctccatgtacagtagcaccaaaggtatttgtacatgaactttttaaggaacactagagaaaaaaatattatcagactatattgtggtggtatattttctcaattatcttgcccttttggccaggtttttcctaaccagtaattcatttgacaacagagtgttttaaatcacagctttattgagacccagtgcacatactgtgtgatttatccatttaaatatacggtccaatggtgtttagtgttacatgtccacagaattttgcagctaccatacagaacatttctctcacctccaaaaagaatccctgcatcctttaacagtcactcgctgttacctcccaacacccagtcaatacccaatagtttttttatccccacaaaaatgtttccataaaaatctgaaatttttaagggactgttttgctaactcattgcccaatgaaaacaaataactcagctttgtttttcttatgagctcctgacaagtatagcaaaccggagaactactcaaatttttactattcctttcatttaaaaaatacatatgtagttatttatttcctttgaacagctgctaccaactgatttctaaaatacatgttgtcatatgcctgctaaaaaggctgtttaacaacataagcattccctagatctggcaaaacataacctgtcgaatccaggttcattgcagttatgattccttagcagttatctgtcctacttctgggcctatttgcattttatgaacacttttacctctctgtgtaccttgaaattgattatggtagtagctatatatgtgcaactcagggtcagaagggaaaatacgccagccctttatgcttcatgaaaaatcagccatttaactatatatggcaaaataaaatgtgtttgacattcttttttctttttggacatgtctttgtaataaaagtgctgttttataatgttctagaacacagccaagcaatgaattacataccattttccactacagcttcttcccttcactctgagttgcattatagtcagaaaatgcgtttttgtctgagatggtatggaagcattttaatactaacatgatttcatcacattgtaggaaaaaatgtgttgcctatattttagaggatggaaaattgtaagactaaaaatttagaatcagtttttcaatattttattttattctggaatccttaaggacatatttaagcctgattcaatggtgattaaagactcagaataaaagaatttaccagtatagaaagtaagctcctcctctccccacaaacataatgtattttactcttagtttgatatgaggtcagctaaagtaaataacatatgcaaataatacacttggccgggcacagtggctcacacctgtaatcccagcactttgggaggaggccaggagttcaagaccagcctggccagcacggtgaaaccccatctctactagaaacacaaaaagttagccaggcatggtggcacgcacctgtagtcccagctactcgggaggctgaggcaggagaatcacttgaacccaggaggcagaggttgcagcgagcagagatcgcgccaccgtactccagcctgggcaacagagtgagactctgtctcaaaaaaaaaaaaagaaagaaagaaaagaaaagaatacacttaaacagattgtgtttaccatttaaatatagggatctctctgacttgaaaaatattcaaagacagaacaataagaaatacctttaaagtcagcttacatccagtttatgctagatataaatatcttattcatgaaatatagtgaagttttctctgttttaaactatcatttttgcaaaacgtagcaacatctcctaatgacaagtggaaagcttaatgcaatatttaccactttactgctacgttgcataaatatttaattggtgttgcatatgtcatttgcttttacattagtggtactaacagcggcatattcagagagaaatgtctgcatagagaggagtgaaagaaaagtaaatggcataaataaggttaaaaaaacttgaattactaggaattttagaagtgaattcagcataaaacctttaagtttcatggaaactatatcaaacaaaggtttcatcctagaatatacaaataaagatacaaatatcaaaggtttcatcctagaatatacaaataaaatttaaatttgtatagagtttgttgttcccacatcatcttagaatgtctgcagactgctcacattgtcccttttccttaaaaataagattccaaagccagacgtggtggcaagcatctgtagtcacagctttctgggaggctgaggcagaaggatcaccacttgagcctcggagtttgaggctgtaatgcctgatgatcatgcctgtgaatagccactgcactccagcctgaacgacatagcaagagcatctctaaaaaataaaaaatagatttaaaaaaattccagtttcttctttagtgactttggtaatataacacctgtcagaaaaggaactgaccattcattcatccgtcattcattcaacatttatttatcaggtgactaccatgggtcagacactgtgacagagacagcagtgaaaatacagtccttgcctcttagagattatattcttttgtagaatgcaaacactgagtaattaattacagttatagtaactgtttgaaaaggagaaatgtaggaaactaagagagtgcataaaagacagaactttactgaatctgagcattcaagattttcctgctaaggcctaaataataactgagattatgtgttttgacaaatgctgacgtagggacagattctaagtgttaccacataaacctaaatgtgacccaaaaatatcaactgtcagggtattaaaactaatatattgtgatataatgaaaatttatccatgtgttaggggaaaaattttttttttttttagttttcattattgacttagtttacctagagcccagtgttccagttaacatctagaagtagaaatgtcactttggaaatttggggtaactagatctataattgccgcaagaatcccatagtctctttctgtttgttcctttctcttaatttcagataacgtacatgcatgctttaagaattttatttataaagaattttcaaaaaaatgtttttaaaaactggtaaaggaaaagatatctctgacttctttccattcatgagtactcaatctgttttgaagaaattaaaaacatacagatgtgtgtgtctgtatcctacatcgcaaaagctgtttggagataagcgtcatgttgccctgtgtttgataactaaggaggtcagcacgtctcattttcatgattgagttgggcctaaaggtgcaaagaatcttactctgaggcccccccattgtgcatcttcccattgtacagtctatacagtgactcgaagaacaagtatgtttttttagctagatccacctctgtataatactaagatattttctgagaaaagatttcatgttattaatgataagaacttccagtccttctgttacctgttacattttatcgtggtgacttatccgggagggaattaatgctcctcttctggtggctgtccatcagccagcctggcatgacattggctggctctgtcctgggattgtcttatcaccctaatactttagccactgcctgatcctttctgttttctcctccactggggaacccattctctttatgactttcagtaagcctccacctgcccctgaaggagaggaaacctgtcacatattatcctgcatttcccagaaagacagaaggatatccaaagctacctagaagattactgcatataatttgtagaatatggggctcttggttttgagagaaaattgtacaggtggttttgcagatttcagatttttgcttattttttcatgtatctccttttaattatttctaatatcaaagtcaatttcattaaacttagctgtttttgaataccttttctaaatactgaattcacaaagatgagtaagaagtaatatttatcacagtgatctcacactcttatatgacaagatataatttgaaatttgtataccatagtacaatttatttttaaaatactgttaataagtatagactctcaaagcagccagatttgtgtttgtatctcacctttgtcacttaataactatgtaatcttgaacagggtagttaaccttcgtaaacctgaatttcttcctcaatataaacaagtttcaaaatagtacagctatggggaaaattgaataatgtgcctggcaaaatgtaagtgctcagttaattttagctcttcttcttcttctttgtaacaacctagtaaattaagtactattatccacacttttttaaaagaaaaatcttaggcccagaaaatcagtgacttgtccagtcagcaagtcctttaaaaggaaccataatctaggtctccttattttaagtccagaacttttcccactatatcacagagcattgtttctcctaaggtttaagaatttatagatagaacatgaactgaagaataaataacaatgaaagacaaaatgagaaatgaattccattttgaattcttattttcttatgtcagattatgtcacgaggaaggtctcagcagatgttagccatctctgacacttgcctttaacatctcttttacaaataaagagtaatttggaccgggtgtggtggctcacacctgtaatcccagcattttgggagcctgaggcgggcagatcacgggttcaggagattgagaccatcctgaccaacatggtgaaaccccgtctctgctaaaatacaaaaaattagccgggcgtggtggcgcgcacctgtagtcccagctactcgggaggctgaggcaggagaattgcttgaacccaggaggcggaggttgcggtgagctgagatcgtgccactgcactctagcctggcaatagagcaagactctgtctcaaaaatacgtaaataagagtaattttgctgatttctattcatatcaagatacactgatttttcccttaaggtaatacagaatttcctttagaaataaatgtattaaaattttaagtcaatcacttaaaaaagaagtatataaatgtaaaatactgacttacaaaataatactatagaaggttcactattataaaggtgatcggcacatttttaccaatacaggaatcactgctgagggaactgaaaatgctgtggggcttttccactgggtttcccaattttattccagatccttaatctttttgttaactacatttctagttttaacaagctaattgcatgatatggttagtaagcctatatgagttacatagaatttgtttataaaacctaactatattgtttcagtcatttcaaataatcataaattttacattttccatttttagagtaatgatatttttagatgcctttttttacttcttcaaatacattcttcatgatcttggaaaagagtcacataaagagaagcattgcatgtttaaaataagaaagtgggccatttatttttaggaaaggagactgagaccaccaaatacagaagcaggctggcagtgtgggcaagtctcccagggatcagagactgcagcttcctctgtgttttgctttgaaatatatttccacaaatgctccataaatattcattaataatggttaagttaggagtaactaaggaaaactgctctccgagtgatcccagatgaagagggagcaaatggaacgcaggcttcataagaacgtttttctcctctgcctgaggagtaagatgagacactcatgggagactgatgtcctctgtccaaataacccttacctacaaggtgctgcaggcacccagaggccgtagtgggttccacagccctctgcttctcacagccagctgaacttgataaggcagtctcacagccagccgaacttgataaggcagatacccacttcatcttagttgactgagtgataaacaacaaatcacatgagctgctcgtgcctacattactgaaggatcattgattctgtttcaagtttcctcttgacatacacgtgcacctgtgcaaacacacacacgtatacacacactcacgaatcagtgtctgtctcaaatgtaacgccttggagaactggactattacataggagctgtttttcggattttgccatgttttaatatactgacattcttctaaggatctccatatttcaatagttggatctttcagtaatggtgattacaatgccttaaaatttcaaagaattgtaattttcagtttgtatattttaccattttttaaaaagccaaaacaagtgaagaaataattttatgcttaagtcagtagcatacataaacatttgttacataaaagtagtatgcagtttttttttgttgtttttttttttttgagacagagtcttgctctgtcacccaggctggagtgcagtggtaccatctcagctcactgcaacctccacctcataggttcaagtgaatctcctgcctcagcctcccgagtagctgggattacaagtgtgctccacacgcctggctaatttttgtgattgtagcagaggcggcgttttgccatgttggtcaagctggtctcaaactcctgacctcaagtgatccacctgcttcggcctcccaaagtgctgggattacaggcgcaagccaccgcgcctggcctatgtgtgcaattcttaaagctgttatgggagaaaggaacccaaatgaaaattgagtgagtactgcaagcctttgaataatgagatagatctattggatttcaatggcaaagctgcaggtaactcactaatgaatcatctattacatacatttcacaataacaacaaattcaatattttgggaagcagggaataacccacaaatcatgtaaatgatttcattctgtattttgaatgttattgaaataagtcctcttaccatactcttcaatattgacaagtattatctcaaaaattctctagcttataggtaatggctgacccctttgggcagctgatcgtgacggttaacactttgttctttccattacattggaggatgaatccttcttttattcagagaacagaccctttaagcaagagaaaactaatgaaacatcaggaaaacagtctgttttagaaattctaacttaattctctctgtgacagaagcaacagcttgattttcgttttgtcagcttcagcattggctgtcaaaggcagctctggaattagcatttcctgagccgcatccataggtgtcttactctgcatccacgtagttcagaaagaaaaaatgcaaggaaactttcaagtagaattgtttaatgttatcatttataaaagaatatgagtcaaatatcctggcagaaacaaaccttcaaagctaaatcactgtgtgttcccatcaaggcattttgatagccaatatgattcttttttcccattaattgcattatgccaagaaaggatggaaaggaaaaacagcatagaaatataaaatattggcagccattctgtatctccctccaaacctgttcgttcataaagcctatacttttagaatgttatcatgtaatacaaagaggaacttcctatatcaaatgttagttcttttgaatataaatatcctacagttgacagaataattttattttccttaatgacaactagagtgcatattaatatgaaagctttcaaaagaaatattgatttaaaataacaatatttgggtcagcatgctatagagtgttgaaataatattagccttaaaagttaataacaaataataatgaattagaatgccaaaatattgcccaacacattctgtcaacacgtatatgaacacagcaggaaatccaaaacaaaagctaatttatagagaactctgtgttcctaatgacagtttagaccagtaggggtccaagttacaaactgcagtcttcacatgcgatactttcattttacattgaaagcttggttgcactctggatacatgtagccaatcaaatgattgccctatatttaagagtatttttcttatttttttctgtgaaatctgattattagcacatgaaatacacatgtgcatcgtgtatatttatgtattcatgaaattgatacataaaatgaaacaattctgcattcaaagcccaagatatccaaggaatcgtatgtataacatgatagtttgactctatgcaatgtagttttaaaaattaaaatcaagaacaacatcggtattctaatgtgttgacatcttattgatgccagatatttttccctgtgctcaataatttagcctaaatatttgtattttaaaatatattaacatcatagaatataaatctggaagagaccttagaggtcatctagtgcaaacccttcagattttctttgtaaatgagagagccaagcctcagaaagatccagtaacttgccaaagttccacaattatttaaagccagaattcagacagggactccagtctcttttaatacaaacaaaaggccccacaagatgcaatagacaatctgtgttgaaaacaatgtacttacctatgtaatgtcagactctgattttattttctgcaacttaatatgttcctaatgaatctttctcagaaagattccttttggaagtgtaccacagtgaatgtgaagtgaattgcaagaaagggaaactctacatccttgcttgctttgatgaagttttgaggtttgggagactaaacaaaatggaatggcaggcattttcagcatggtatttttaaagtcagtttttcttatcagactctctttcccatattacctcatcctctttgtctttgtgagaatgttcacttgatcttgtaatattaaacagcgtttagccaaccctggcaggccctcccagcacgctactctgtgttgccaaaaccttagagcacactcctcagggttctggtggcacacaccaccttcaggtgactgatggctgggtgctcgggtctgtgttcccttcacaacatcccctgtaatttgctccaaggttctggcaattgctggactatgtcaccagctgtcatcacccttccttcccatccatttttggcaggatctggggactcaagcatgccagtagaaataatagtagctgtggtaacaacttcagtggcatggtccccagagacgagatcaaaatttggcacctttttctctcaacatggagctaaaaatggcactgaatttgttacttggtggtatataattttctttaattacacatttttggtttcaagtgttccacatgctggcttttaagtgtgacaccaacatatacgggttaaaaacaatggcatgccccctttttattttatggggaggaggtgaaataactataataccatggattccgttcgtctccagccttggaaaataaaaggaatgcatgctgtaatttctctcactttaatggtctttgtgtgtgaaaaaaaattccttcataaaattttactgataaatctttattaacatattgtctcaaaattatttcaattaataaggttttttcttaattattggaaaaatctacagaaacatactaagagtttgcagaataattttttaattacataagaaagatttaatttttaacatctgaaaatggttacagttcatgaataccacaagacaacctaaaaagatgcagtctagagtagcctatttggctgttagtaacagaggttttgaccacgatcaatgacttcatatccatgttagtcactcctgagttgatattactataatttttttttctcattgacttgggtgatagtataaaaagtatactcattaattttatagatgacaaatgtcagatgttacaacttattttaaagggatccctgtgctacttcaaactttactaaagacaaagcaaatggtttttatcttcataattgttttgttttctgggtttcttttttctgttcatgatatcagtgacttcactgcccaggctaaagtgatatcatgaacagaaaagagaaacccagaaagcaaaacaattatgaaggtaaagaccatttattttgtctttagtaaagtttgaagtaccacaggatttctaggtaggtctagtagaaaaatgtaaagtttgaagtatagcccagtcaggaaagaattcagtgttaagagatacatatttcaaagtcatccatccacatggaattggaagttgatattataaaagtggttaacatgaaaggaaggtcaaggaaggactttggcaaatgtctatattttggggaatacatggagggaggcattgtataagtcaggagtaggcaggttatgaagtggtaaaaacaaccctaaaaacctaaatggctgtatcagtttgtaattgcaactgggcccaacttagctgggtgcctctgcctcacagtctgtaaggttaagtttacagtcaaactacagactggggctgctgtttcatctgaaggctcagctggtgctgcaggatgtgcttccaagctcacacacaaggtttttggcagacttcagtctcttaccacatgggcctctttatgaggctgcctcataatatgacagctggttttccctatggaaagcagtccaaaagagagagagaacaaccaaaaaagaagctgaagtctttcgtaacctaagctcaaaagagacattgcattatttctgccatatgctttccattgtaagcaagtcactaaatcaagcctaaactcaaggggagtagatgatacaagggcgtgaataccagaagacagggcttatctggggccatctcagaggctacctactacagtggcttaacatgatggtttatttttgcttaagctacatgtgcagggtggttcttgtcaaggggtttctgctcactcaaggccctagacttaacagaaacagtactcagcacatttgcatgattactgcatgggaatgcaacacattacatattggttcttaaatcttcctcacagaggtaagacatactacttttgcccacatttctttatctgaagcaaagttataaggcttcagaagagcagggaagagtaactccaatatatgtccaggagaacttagttatttgtgaatagcctgtaagacttccacaaaatgatttaaggagaacaactgggaaccagcagagaactgggaagagaaccaggagaattatgaaaggaaaataaagtattgatgatgtgtggctaataatgcccagtactcttgagatgtaaacaggatgaatattggcacgaggctactggatgtggcaatttaagagataccagctggggatggcgactcactcctgtaatcccagcactttgggaggccgaggcgggtggattgcttgaggtcaggagttcaagaccagcctgaccaacatcatgaaaccccgtctctactaaaaatagaaaaattagctggatgtggtggcgggtgcctgtaaccccagctactcaggagactgaggcatgagaatagcttgaacccaggaggtggaggctgcagtgagccgggattgcgccactgcattccagcctgggtgacagagcaagacttcatctcaaacatacatacatacataaaaataaaaaaatttaaaaagagatacccataaccattgtgagaaagattttagtacagtaatgaggaacatcagttaaagtgaggagaaaagaagtgtgtgctgaggaagtatgtattgtggtctcttcttttgagatacctggtagtaaagggaaggagagaaattaagcaaaaatttgaaagatatcagaattaagaaacccttgaaaatcctgattctgtaagtaagcatgacatttataccccaaacattgctttttcatctcttctaaaccatttgtaaacatgcttaagttgaaggagcaaacacagagaccttcagtgtacagtcagatacagtaagatgctggtcacttcataccgtctgggttaagtttccgactttgtgtcacagtcccatttcttcatcttaacaacaacgattttctgcagggtgacaagttataatagtttttgtttttaattctggtaagaaacacacaacataaaatttatcgtcttacacatttttaagtgtatagctcagtaggattagcattgttgtgcaacagatttacaaaatgtttttatagtatgaaactaaaattctgtacctatcaaacaacaactctccatttctccatcctcccaaaccctggtcatcaccattctactttaagattctatgactttgactacttcagatagtccatgcaagtggaattatacggtatttgtatttttataactgactgacttcatttaacgtgaagtcctcaaggtttgcatgtcgcattctatagcatgtgacaatatttcctttttaaggcagaatactcttccattgtgtgtatataccacagtttctttatccattcatccattgatgggcatttgggttgcttccacctcttgactattgtgaatagtgctggtaagaacatgagtgtgtaagtatctcttcaagaccttaatttcagttctttcgggtatgtagcctgaagtgggattgctggatcatatggtatttctatatttaatttttttgtggaatcaccatattgttttccctagtgtttgcaacaaaatgttgcaatcctagccaacagcacacaagggtttccatttctttacatttgtgccaagacaaatcataatgtttttaaacaaaaatcaatttgggagggccatgagctgacagtcatcaccacaatacatgaatttgtttaatcgtattgctttcctccttaaagtttgcacttcctgagatttgcactgaggaaagtctttcctcactctttccttttcctcccacctggtggagtcatgtgcccttcttctgtactgtcttcactctgcatctgcatttatttgttacctcttcgggctggagcacagaccatcacagttgactcacctgcaacatcatgaaaggaaaggctgctagccttatggaggaaaccacttttagcgaagatttagggagggtaaaaaaatgtatgttatttttagctatgctgggtgttagatggattacttttaagttgtttttttttttttgaaacagagtctcattttgtcacccaggctggagtgcagtggcatgatcttggctcactgcaacctccgcctcccaggttcaagcgattctcctgcctcagcctcccaaataactgggattacaggcgcctgccactacacttgattaatttttgttttagtagagactgggttttgccatgttggtcaggctggtctcaaactcctgacctcaagtgatccgcccacctcagcctcacaaaatgctaggtaggattacagaggtgagccactgcgccctgcctaagtaatttttatttaagtataatatacatttagaaaagtatatggatcgcaataagtgaacacaccattggaaccacctcccagatagaatgtgagcagcactccagaaacctctagggactatgccagccactacctgttccttccttcctagaggtcatcaccatggtgactttcattcttctcagttgattttacctgcctttgaactttatatacatgaacttatacagtattcccttttttgtgtgtgactgctttcttttgcccaacattaggcttgtgagattcatctatattgttgtgtctgccagcagttcattccctaatgctgctgtgtagaagtccattgtatatctgcactataatttgtttttccattctactgctggcagatgtccagtttggggttgtttccagtttggggctattacaaataatgcttctgtgaatattgttgtttatgccttttgttactatgtggatacatatttctatggggtatacaaacagacttttgtagatgcactggggacttcaccaccatttctgagatttttaatatgagaaaatacatcccaattccagacaaccaacttaaaaattgtcttgcaaaatactcccatttatagttggtaaaaatcttgtatttactagttttaacatttggacaacttcttattatatttacctcatggggcaaatataatcattctttctacaaaaaaagaagataatggacttcaaggttttttaaattgtgaaaaacacactgataaatatatatctcagataggcagtattgctgtcatctacaaatttcattctgccttggataacattttggatatgaatccaggcactttcactattatattcacctagaaatacatggaagtgacataaaactaagaagcataatactagaaataaaaatttttcatgattaaatctacatgattatttctgtaaccttaaagttcacaactataatgcttacttttgtacttttgtaacttttaagttgttgttttttaagaatcttggagttaaacaaaatagcctgttcttaatttcattactatcatcatcatattactgtaaaactttagttttagacagaatagtgggaaagtgctgcgtagaatggtgcccaggacacacagatgtcacctagtgatatcctcggccccagcccccaagtactgccccagcctgcagtgtctttggatgtagtagagaagtgttatcgtagcctgtggcccccacacaagctgtgtttcacttccttctctatggattttcacatcccactaccctctggtagaatacagaggtatgtggtgatacatcttttgtcatcagaaggtcggggtttgaggttaacatccattgcaaactgcatgcaaactctcaaacaaccttaaactctcaactaatctccactttcttggatttaaaacgaaaaaaaataagtcataataaccattcaacagaacctttgtgaagattagagataataccaatgaagtactagtacagttcctgacacacagtgtttgttcaatgactggtttgaaatgcatattgcatcatgatgttctaccaccagcacaaggaccatgtctgtggccggggatgcctggtatcactcctggcttgtacgtcttcacctgagacccagggcagtgagggactcagaagagcacagcgcccccagcttcttcttgccactgtctgcacaccctacactgggacatgcctaaaccaaggatcctttgtgccatccatgaatagtggcagcaaatgcttttccatgagttcagttctgctttccaactcaggcattgaagaactggacttacccttctttattttcagatgtattttatttggcgaattttccctttttttctgccagataccccatttagttttattacaccactgctcagtaatttctgtagcattcttgactttcatgagtttgctgcctgcctctctcctttctctccttcttctcgtctctctctctcctctctctaactttggagagtcagccccactaccaccctgcattcgtatgaatatcttaaattatgcataatgagagtcaagggcatcactaaatacgaaacaccaacaatttcaaagtagataatatcctaagaccaaacaactcattggtttctgttttcaatgcagtattaaagagataatatttctggatatgagtctcattatatagcatcttcagtagaaccagcatctcactttattgagattttctgtaataaaaaaaaatatatatatatatatatatatatatatatatataaaacaaagctgttgcctatctggcaaaaaataaaatagctctcccaacataaacattacattactttctaacatatgacatctgcgcatgatcccatggattatgtctactcttcaaaatccattaaaaccgataatgtgagcaaatctatcaggcaagaagactttttatgttaaaagatcacaatgatgacaaattattttgtgtggaaactttgaccctcttggaatatttattgctgctatgccagagtgtgtctgtcaaacattttactctatgcaaaactaagctcccattattttgttcaaaactcgtgaagcatctgaaaccctgaaaaatgtatgatgtgataagtgtttagcaagtcaaacactatgcaatttaatgcagaatgacacatgaagttatacctttttacatgatgacaacttgtaaattgaagaatcctataacctatatcttaatccgtgaaaatcagagtttaggccgggcgcagtggctcaagcctgtaatcctagcactttgggaggccgaggcatgcggattgcctgagttcaggagttcgagaacagcctgggcagaacggtgaaaccccgtctgtaataaaaaaaaaatacaaaaaattagctgggcgtggcggcgtgcgcctgtagtcccagctactcgggaggctgaagcacgaaaattgcttgaacccgggagacagaggttgcagtgagccgagatcgtgccactgcactccatcctgggtgacagagcgagactccgtctcagaaaaaaaaaagaaaatcagagtttaagaggaattgctggccaaggacaactttagcagggagtgtgactatatacatttatttaaaatatacagggtagatgtcgctatctacctatttttggtatctttcttactatagcatgcttttatatcaggtattattaacaaaagaatgtggactgttaatagaatatcctaaaactaccaaatttttaaagtttagttaattacatatagtagtagtagactttcagtcaactgcttttcagacagcattatagtaaagcagtcattcatccgttactaacatgttctcctctcttagccttacgcatttgttttctatgtattaactttttctctaaattactatattttatccacacagtgttttcttagatttttaaaatctcagaaaatagaatattcctaactttaattcatttatttgacagatacttattgagacctactaggtatcaggcactgtatccttatacaaagttatatgtcttataaatgagatacgaaagtcaactaaaatagtcttaggaaaaacacttcacccagtcagggtatgagggatgcacaggtattttcctgtcagggagaagcattgcagacagaagggactgtttattgaggggtgccgtggtctagtcaggtgactccaaatagttcggtaacctggagtccagactaaataaaatacctcagcagtaagaactgtccagctttgtgccagctctccttcatatgccctgtctagaatcttctggcctacaccttctcacctgagcttaaattaaataaggtggttgtaacaaacctccttttaaaaataaacctaatttctaacaatatcacgtaatttatccaaggctaaattctagactgaagattgaaccaaagtctgactgcatccaaagcccctgctccatgtactgtagcaggtcagtgccgttactttatgtattggatctgaagggctttttgacagtggtagtcatcacactgccttcttattcttcctccattgcgctggtaaattccagtacatacagtaagtaaaataatgtctaaaaatatcaaaaaaaagttctctttcatgatatggtaatatgaccatcactgggtttccctaaaaatatttaaccttccttaggggttagttcctaaactatattctgtgcagcacaaatgaatgtttagtatattaggtgagtatgacagcgacacatttttctaaatagcattgataaattaagaaaaataatacacagggtattcacatttcaaattatgtctggaatttaaaacttatgtttatagttgtatagtcttctagttattttttaaattttttaaaataaagcaaattagtaaacataatcataaattttaataaatgtattaaatataaatttatgaaattattttacccacatcagaaactcacatgaaattacctgacacatgtacatgctttttaatctgtaccattattaaattgtttgtcgtcaattcaaaaattactcatcccaaatttagaatattcaaatttgattatattttgtacagctgaatttcatgtaccaacaaattcatctgtgagacaagtttttgggtttaccttaacgcaaaggtagaggatcatgtctcttaagaatctacaggtgttgcagcaaagtagcataaatttgcaagtgacctgtggtctagtaagtggcaaatgctgttatagggtgttctaccagttacttaaaagatggtgaaaaatggaactcaattagagcaaataatgattgattcctaagagtttcctggtaccaatgaagtgaatagtattaaatcactattgaagtgccaccatattgccctgcattgctatgtaaattatatttgtttgaggaactctttgttttataattttcattgcgcagttatccttggtatttcagaaaatggaaattgtaactttacatatgactcttgttttaaacatgcttagcaattgccgttgtagctgaaggcagcagatctttaaacaacttgtgttctttacccccagcaatgcatctctttggcctcaactggcagctacagcagactgaaaatgacacatttgagaatggaaaagtgaattctgataccatgccaacaaacactgtgtcattaccttctggagacaatggtaagcgaaagaattatgtatcctgtgtttctcttttaacatcccttttccataaatttatttttacccatgcttacatctagtttagatggaacagggaaaagtgttcgaaattacagatatcatctttttataagtttttttcaattaatttacttgaaaggttgaaaattcacatttttattacaggaataatatgattttctgccttctgatttgatggctaggcttttctgcctttcccttctgcagatgtatattgagttttatttttagtctgcaaatagattataattcagtgtatcatctcttgtattaccttgggtttattaggttttcttcattcaacttgcgtgtggagttggaacactgtattaattttattataaaagcatttaaatgcaaagcacattaaaggattatagtttattgaccttttctctggttgccctttctctaaacctttaagaatttgcactttgagctaacaaagattttgaaatcaattggctctgaattaaaaatggaatttaagtagttagagaattccattttttcaatataaacacttagaaaagcgtatacatacatatgtacacttacgttacaaatagttttatattatttctgtgtgtgtgtgtgtgtacatgtcttggccttggtatcctctgactttttgcaaaatatcataatactttatatctcagagcatcctgatgaagacgcctttttctgtcatctggttaataaattatttccctttaagcattcccctaactcgtcttcctctttgtttcttgtctagtatattggtgttcagctttggcattaatatgtctatcctcatgtggctggtttctttgcaagactggaaagaaattattctacatttaatgaacttattatatgttgctgtgtcacatgtacccatttactgggatgaatactttgtacacttttttattcttttttttcctaatgataatactttatgacattctctttctccttagggaggttgaggaattttacgacattcgatttttataataatagtgaatcccccgccatatggaacctttttatataaagttctgcatgttccagaagaactgtaagctggtgactgacatgtcacccacctaaagtagacagtggcagtcactgtagagggggttaaagagggttgaaactatagattgggaaattttaattacataaatttcaattaccttttttatacattaataacatatataaacaaaatgagtaactatacagaaattaagaatatttattttggtttgtattgactgaaatttagactgtctcttaaaatgcatggttcctgtgaagatgatcgaatggtacttattaaccatacatgtagggaacttttttacagactgaagaaattgtaattataccaaagagacaaacgcttattatggatattgtatttattttacaacatcttaaccttttattatgattaaaatgaaaatagagtttggctaattagtttcacagtcctgaaaagcatgatactgagaaagctgtggatttagagactcccacagcctgggtgctgggtgctggctgctggtattttgccagggaatacctctgctcacgtcagcactcctcagctcacagaagcctatattcaaatcctcgctctttcgcctgtttactttgtaactttgggcggcgtgcttggttattcagatttgcaagaaaattttagggcagctgtggaatgggctgcctaggatcctatcagtcgcagaggtttggaagaaaaaagaacatcacatgaatgtggccatattaatagaaatctccgtaaagctggagtccttgaaaacagtggcttttaagctattgaccatgacaatgcaataagaaatacatgttacatcaaagccaacatatacacacacatatacatatgtatctgaaatatgcttcccaaaataatatttatccttgccttgtaaaatgcatcctgggattttccattttattttattgtatttctcatttttaacaaacgccacttgcaacccactaaaataatttcatactttatgaaatattgtgctctgtaatttcagaaatactgctttggtagcctccttctctaagggggactgaagttcccccaagtgatcatagaattcagttttatacagttctgtgcacctttagagcacctgtatatacatataagcgaagtactttcttcctagatgtgtaaaagtctcctatatagggaatggttaacggaagccccagaatcagttaagtgcactagagaactgccaactggactaggggatttgtaggaatttccctgcatggaaaagctatctctctctgggctctgaccttgtccaaagagtgacctaactattagttacttgccttctttattattacttgaatcgcccccaaaaccctaaattgtaaggaattcttgtttctgattttccaaatacaagttcttaatatctcctaaatattgttcttaaagacctggggcacagggagtggacgggaactctatttacaaggagggaggtagctgcaaaccgctgcttttcggctttcgtgatgaacctcagtgtccatgcaccaccacccaccacccactacttaaattttatatgctatccaagaagcagatcacatcatctctttagaaattctaggagattacaacccttgagaaagctttagaattctgaacaaagctcactaggagaatgaactgtgaaaagcatagtgagaaaattatttcacagcttctaaatgtaatactcttacttgtgcagtcctattttactcttattttgtaaatataattctaaggaacaatcattgtgctaagggtgcagtaaactccctgcttgcatttaagttaacagtgagccaaagcttctaaatggtatttagtatctaaaagaaggatttctgttatatgccatcatcctttactgattattcctgagaccttctttgcctacagattttagagatgagttatcagaagcgtagggtcttagacaaaactgatggaaatggacaaagtgaataaagaggtaagaatgaagtttgtagctcaaacactggtctctttccagaaactaaaattattcccctggcccaaggaattcatttagcctaatgtactggaaagaatcacacagttctatactcaaatcctggctccttcatttatttactttgtaaccttcagcatgttacttcactgacctctttgagcttcaatttcttcacatgtaaagagggaataatagtacctatctcctgactttccaaattcaacagtcggcagccctagtatccctctcaaacttctccccaccatacttctcaacaactatttcagatcttcctgctatactcaaacccctctctcagcagatgaccctgcattctattaaaaaaaatagaaacttgcaaggggagctctcattttctgtaaacacatctttattcctccacatatgtggatctatgcttccaccttttctccccatattccaggttcatctttgcgggggtcctcttgatcccattctctcttcagaatgtcctcattctactgataccatccagtcaacatttgaacattccagtctctcacatcttggaaaacaataatctcttgactttgcctcctactgcctctctcttctaccagccttctttttatttatttattttatttgtttatttatttacttattttgagacagggtctcactctgtcgcccaggctggaatgcagtggcacagtcacagcttggctcactgcagccttgacctcctgggctcaagtgatcctcccacctcagcctcccgagtagctgggactacaggcacatgtcaccatgcctggctaatttttgtatattttgtagacagtgttccaccgtgttgcccaggctgccttgaactcctgagctcaagcaatcctcctgcctcagcctcccaaagtgctaggattattggcgtgagccacctcgcccggtgcttccagccttcttgaacatagtgtgcttagtcactttgatcacttctctgccttctgtttacccccttacagttgggctttcacagtacccctagctcatgacttgtcctcctctaccttcaccacacactcatacttcactgaaactgatgtctccagagttacccattgctttgtcagtagcaccagtgaaacctctttattctttatcatgtttgagtttttggaaccatttaatagttaacctatccctcctgttgcaatagtctttccttagcttctgtgataccacattcactttgactttctccctgactgttttggcaatgatgtctctgtttagttgactcacctcccgtctacctgatccctaaatactgctgtttctcaggactctgcgcttgacaatataatcactctggattctgtcacccactttcatggctccagttacattctctgtgcttcctaactctcaaatcagtaagtccagcctagatgtctctcttcagctccagatctcaactacatattttgtagacagtggtggtagtagtagactacataaaatctacccaattgtctttggaacatttccacttgggtgttttccatgcatcttaaactccacgtgtctaaaacagaacccatcaactactttggttatctattactacataacaaaccataacaaaactcagtggcttagaaagcaatgttatcatctcttgtggttcagtgaattggccaggtacttcttgcgttcttacttaggacactgcgattgctttcagatgttaaccaaggttaaccaaaggctccactgagctggaagtccagggtagctcactcacatggctggcagttaatgccatctgttgacctgagctcaactgtagtcaccagctggggcacctagacatggccttccatgtggcttgggcctcttagaacatagcagctggttctgaagaggaatatcccaagagggagcatgccaagagcctgacagaaactaccagctttgtataacctagcagtcgccattctaggctttcactgccatcacattctgctggtcaggaagtcagcaaggtcagccaagattcctggggaggggaattaaactcctcctcttgactagggacctgttatgccattgcacaagggcacgtgggatggaagatgctgttgtggccatctttggaaaatacaattgccaagccatctttctttccaaatttgcctctctttcagggatttctgtacagtaccttcccacatccccccctccacagttttgctttttgtggttttagttacctgtagtccactgtggtctgaaactattaagatactttgagagagagagagagacagaccacattcacttaactttcattgcagtatattgttataattgttctattagtatctttttcttgcctaatttataagctatcataggcatggatgtataggaaaaaatatagtatatatagggtttgatattatccacagttccaggcatccactggggatcttggaacacagaccctatggataagaagggattcctatattaggaaatggcaccgtcgttcacttcatcactggtccaggaggcccggtgactgcttctactctctcatctcccgtatttagtcagtctctaagttccttcaactctgaccccataatatcttttgaatcctgttttctctcagctggatatggtagccttctatctgcgctgtatgtctccagtcttgctcatccactcttcacacacaaatttgagatatcagttccttgcctaagccccttcagtgacctagattctagtcagaagcctttaaatgacttacaaggctctccacagcctggctgtacatcacaccatactgcaatataaaaacaatagcacacagagacaaggagtgtagagttacgagcctcaccacctgatgtggtgtcctagttctgatcattaacgcctgtgctacttgggacaggttatatagcttcattgtgcctaagtggtctcatcaattaaaagggactaatttacttcatagaatggtctttggtcttgaatattcaatgcaaatatacaaaggtgtaaacatacaatggtgtatagtacatagtaaatgcttgaaaaatgtttatggttgtcactattactatttaatgcatctcatctttactagactataaggcaaggatcctgtctgttctttcactgctgtataccaagctcttggcacagttctggcatgtagtaggtgctcacaaagtatcagttgaatgaatgagtgaaaataatacaactaaatgatatgatataaagtatacgaagggccatgcatcaagtatatgcaaagtactagtatagaatagtggctaagaactgaagctctgccactcactgggtgcctttaagcaaattaccactctcacctcctgtttctttatagggtaatataaaggtttacaatgaggtttgaatcaggtcatgcatgcagggtgccaagcaatgattggaacatgaaagctattcaatgcatatcagtgattgtttgctcttcattctgcaattcaagatgatgcacttgtaattcatagcaaaattttaagaagacacttctgcaaatcagcatcggtagtatcctctaaagcaataatggaaatccccatcattcgttatttatatttttagttatttgaattttatgaaagaaatattatcgtgtattttttaatgcatagaatttattcattttacatttgtctaatgagcacttatgatgtgccacgcactgagcaagattctgggaatatagctgtaaaagcaagatgatcacagctattgtttccagagcatgtgaattctaggctagatgggaatcgagcgagttattacagtgaattagaaaatctccgttagggaaaagcggagtgtaccctgacagaacatttcaacaccagcttgacttctaaaggggcagtaagacacatgcccaattttagcctaggataatttaggataataaagactgaaataaaaggctatatattacaggcaatgtaactatggcaagtgacttctccaatcaaaagaactctttttgtatggatacgagttgaaaaactacaaatatgtgtgtatgtgtatatatgcatatgatttatgctgcttaaacaaaacaattccaattgcttttaaattttaattttttttttttttttttttttttttgagacggagtctcgctctgtcacccaggatggagtgcagtggcgcgatcttggctcactgtaagctccaccacctgggttcatgccattctcctgcctcagcctcccgagtagctgggactaaattttacatttttgatcatcgtgtatcaactttctcaagtactagacaactctagagagttcagtctgacagcaggttgcagattccctgtgaattcgagaaatggagctgacagggctgcaagagcactgagttttgttcaatagtgttcatagtacttgtgttattacaatgtgtaatagctccttaattagatgctatattgattttgtccattaagctatgtttgcaaagtagttatgtcttatttcacttagcttgtgatgtaacactctgtatccacaatgctaaattatggcatgcggttgtttataaaaagatatgttctctcagagatctcaaagccagggtatgaatccaaggttaggtcatagaattggagggtgggctactgattgtctacaaatgcccaaccttgcttcctgacgtcttaattattagtgcctctgtgggatttaagatgatattatcatttaccttccgcaacaattgcagttagactttgacagtgaatttcttttctgcctttccgtttcactcattataggcttgtttactcacatcataggcaggtggcaaattcatgatatatatggcagaaaacttagcattttataattttcactgatttttctgatagcacaaaatagttttcaaacagataccaaacctcctaattaccaatatgactttaaatcttctgttttgtccttacagcatctcggttggtaaactattatttataaagtgtttttcagttcaaagtacttttgaaaaggcattatctgaaaagctgtcactccactgatgtgttttcatatgaactgggtatcacataagaaggagaggaataacaatagctttgcgtatgtggtctctctctgttttcacactctgacaactgtattttaagacattaagactgttgtgacacatacttactgatgaaagaaaaaaatcacagttagtaggtgaaaagactgctagtggctcccacattcaggcacaacaggacacgttgaaaaaaaccttcaagatgataccctattgtgtttgaagacgtggtacgtttcactcttactgtgaaggctttaattggtttgattcctaacccacaagctttgagtttagaataactacagggcactctgttgccctgtctctattttttcctccagttttcctccttttccttttagtaaaacctacagacaaccttagtgtttcctatgatcattcccaggttcaggctctagggctttatggaggtagtgatctcagtaagggaggatagagagccctagaactggcctttttttatttcttctgaagccaaagttttctggaattcgggacatgatgaaagacttctgtgtccaggcttttatctaagaggactgatgagcttcagaggaaaaagttgtgcaagtatttacaagtttatcaaactgtgtcaatggcccactgacttccaggtgtgtttaccatcaataaagagcatttgaaaatgctaacaggaatgaacacacttgacttgtccaaatgagagaatggctgtgacttgaaaagcagcagtgcagaatttaaagacaaagccccttcacgaaaccctagtcccctgtattcaaactagaggcttaaacaggaaggctgtactaatctaagctgccgtttcagtggatcttgcagagaaaaatcagtgatgtccttatatctctacatcactgattagaaagagaggtcagatctgcaagtaccttttagaaaagacacattctaagactgtaattcagaataaattcattctaactagtgtaataacttgaagcaaatagaagttgacaggcactttagagatgagattcatatttcatgggaaaagctagaatagatcagtgggcttcaaactattttgtttttgtgacccccttcaacaaaatagctatacaaatttaaatttatttattttttgagatcatacgttttaaaaaacctgttttcttctatattaaattatacttacaattattagttgtacacatttgactgaaaacaacctaattcttatataaatgtgttaaacatgttgataatttgaaacacaaaaagtgaaaatgtattgaaatataaatgtgttaaacattttgataatatgaaacataaaaagtgaaaatgtattgaaagtacctctctgaaatgaatgggaacttttttcaaatagtttgtatattcatagatgaatataccttataagaataaaacaaaattcagtttcatttctaatcctgttttcctttcttatgaatataaacaaaagaaatcttgctacaaaataagtaagtgacaatgggaggatttttttaagtgattctgttcagttatttgacattcttgttagtcatatgtcaaaaatcacattgtgatctatttctaaaaaatacgttgtctataagctgccagttctatcacatttctcataaaagcaaggaatcagcaactaactactttgaaaaagatttattacactgtttttagaaccaatccttttcccggtttctgtgtaggatgccaaaaaagactttaccaaggcttagcaaaatactgctaattttacctgttattcttctacttagtggtactttgtttatctggtatactcagaatgcggtgaaaaatggaactttggctcatattaattcacctttgatactataattttgtaatgctttcatcgtattacaggaagatcttattttattacgctttatcatgcctcccagataccgtgttttttacaaactgaatgtttgtggcagccctgcgtcaagcaagtctatcggcaccatttttccaacagcatgtgctcacatcatgtctctctgttgcattttggtaattctcaaaatatttcaaactttttcattattattagatctgttacagtgaccttcaatcagtgacctttgatgttgctcttataattgttttggggtgccagaaaccacacccacataagacagcgaacttaataaatgtgtgtgttctgactgctccgtgaccagcatccccaccatctttctcttcttggacctccctatttcctgagacaaaacagtattgaaattaggccaatcaataaccctacagtggcctctaagtattcaagtgaaaggaagaatcacacgtctctcagtttaagtcaaaagctagaaatgattaagcttagtggggaaggcatgtccaagatgagatcggctgaaagctaagcctcctgcaccaaatacttggccaggttgtgagtgcaaaggagaagtttttaaaggcaattgaaagcacgattccagtgagcacatgaatgataggaaagcaaaacagccttattactgataaggagaacatttgagtggcctggatagacgatcaaaccagatataacattcccttgagctaaagcctactccagagcaaggctgtctcttcaaatctatgaaggctgagagaggtgaggaagctgcagaataaaagtttgaagttagcaaaggttggttcatgaggtttgaggaacgaacccgtctctgcaacataaaaatgcaaggtgaagcagcaggttctgatgtataagctgcagcaagttatccagaagatctagctaagatcactgatgaatgtagctacactaaacagattttcaatgtagatgaaagagccttagactggaagaagatgccatctagggttttcatagctagagaggagaagtcaaggcctggcttcaaagcttccagggacaggctgactctgttagtgatgcagctggtgacttgaagttaaagccaatgcttattgaccattcctagaatcctagggcccttaagaattatgctaattctactctgcctgtgctctataaatggaacaacaaagcctggatgacagcacatctgtttacaacgtggctactaaatattttaagcccactgttgagacctactgctcagagaaaaagattgctttcaaaatattacttctcattgacaatgtacctagtcccccaagagctctgatggagatgtgcgaggaggttaatgttttcatgcctgcaaacacaacatccactctgcagcccatggatcaaggagtaatttcaagtcatatttaatttaatttcaactttcaagtcgtatttaagaagtacattttgtaaggctatcatagatagatagtgattttcctgtgatagatctgggcaaaatcaattaaaaacctcctggaggctgggcacggtggctcacacctgtaatcccagcacattgggaggctgaggcgggcggatcacgaggtcaggagatcgagaccatcctggttaacagggtgaaaccccgtctctacaaaaaatacaaaaaatttagccggacatggtggcgggcacctgtagtcccagctactcaggaggctgaggcaggagaatggcatgaacccgggaggcggaggttgcagtgagccaagatggcgccactgcactccagcctgggcgacagacagagactctgtctcaaaaaaaaataacaccttctggaaaggatttagcattctagatgctattaagaacatttatgattcatgggaagaggtcaaaagactaacattagcaagagtttggaacttaattccaacattcatagatgactttgagggttcacacttcaatggcggaagtaactgcagatctggtggaaatagcaagaaaactagaattagaagtagagcctgaagatgtgacaattgctgcaatctcatcatgaaactttaatggacgaggagttgttcttatggatgagcaaagaaagtgggtatttgagatggaatttactcctgatgaagaagctatgaacattgttgaaataacaacaaaggatttagactatcataaacttagtagataaagcagtggcaaggtttgagagggttgactccgattctgaaagatgttctactgtgggtaaaaagatatcaaatagcatcccatccttcagagaaacctttcatgaaaagagtcaatcaatgtggcaaacttaattattgtcttattttaagaaattgccacagacactccaaccttcagcaaccaccaccttgatcaatcagctgccgcctacactgaggtaagatcctccaccagcaaaaagatgatgacttgatcagatgatcggtagcattttttagcaataaaattttttaaattaagtttgtacgttggtttgtagaaacctattggctgggcacagtggctcatgcctgcaatcccagcactttgggtggccgaggctggtggatcgcttgagtccaagagttttagaccagcctagacgacatgttgaaaccctgtctctacaaaaaataccaaaaaattagccagactcggtggtgtgcacctgtagtcccaggcacttgggaagctgaggtaggaggatcacctgagcccagggagattgaggctgcagtgagccgagattgggccactgcactccagcctgggtgacagcttttgagaccctgtctcaaaaaaaaaaggaaataatgctattgcacacttagtagactgcagtatagtgtaaacataacttttatatgcactggtaaaccaaaaaatgtgtgtacctcactttattgtgatatctgctttattgtggtggtctggaacaaaatgtgcaataggtatgcctgtatatgctttaaatgtgtctatttcattagctcatttaatttatgggaaatagccaccatataatttaactgtcagagccagtactcattgaaatcaaagttaccatttttttgttttgttttgttttgttttgttttgttttgagatggagtcttgctctgttgcccaggctagagtgcagtggtgtgatctcggctcattgtaacctccacctcccaggttcaagtgattctcctgcctcagcctcccaagtagctgggattacaggcgcccgccaccacacccagctaatttttgtatttttagtagagacaggatttcaccatcttggccgggctggtctcgaactcctgaccttgtgatccacctgcctcagtctcccaaagtgctgggattacaggtgtgagccaccacacctggcccaaatttaccttttgtcagaaaaagtctgacttattttttcagttcgaataaattaatctacattttgttagaacctctcagttctgaatccctgctctaggtagagaggtagcaagataaagcacaaatccttgtcctaaccttgacaacgggaataaataaagcatcattacatttcatgtttcttaccttattgctgtgttcttggtagtcatgaaattcttctgcagttgaaaagcattctttgtagaacacttggacacaggaaggggaacatcacacaccggggtcacacaccggggcctatcatggggtggggggagtggggagggatagcattaggagatatacctaatgtaaatgatgagttaatgggtgcagcacaccaatatggcgcatgtatacatatgtaacaaacctgcacgttttgcacgtgtaccctagaacttaaagtataataaatacataaatacattaattaattaattaattaattaaaaagaaaagcattctttgacagtagttggggtgagtgataagttcattaaaaaggttatctctctttcttgatgtatttgacttcaaagcatgctagtagtcctaaataccccattgttaaccccacattttgcccttaatggaactatgttaagcagggaaagtcgctgaagccctaccttgggtttatggtgtcttcaataaaagaggcttcaccaccacaatacttttaattttgcctttttttggcatactggaagttttatgctccaagacaataagtcatagtaatatttgggtatgtgagaggtacgcctttcttttgtaaagaaagtcaacacatgaatgttattgagggtctattaatagaaattaatctcctaccccgttccttattgaaaagttttaatgtttcctagggatatggctacccttttttaaagacccctggactagatgacccccacgggtactagaactcgaagattctgtggtgttatgattaattaggtattttttcgttacgggaggaaaaaaatcatcacaattgctatcccattcaagcacactccaccaatcttggatcttttgttttacaaatgaagaaccctctttttctggaaaagaaccactggttaaattacctatatatgggactaacaggataaatagatatacttcgcgacacaacgatgtattcacatatcatttctgtgagaaagattttaacccctcaaaattaatttgtggagaaagaaacaaggcaagaatacctagcttattaaatgcctttgacatagtgaaaccggaaaccctagaaatcagaacttggttaccattaccacagctaatcctcttgggtaaacataatgttttggaaaaaaattctgaaattggcaccagtttatgaatttatgtttaccagttctcaaagcacaggtatgctattaaaactcagaaaaccattaatagcagcaatagggtcaacccaagagagtagattaaattacatatgcttcggatagtagatgaaacttgttaatgacaatcaagtatcatagccttagaaatgtatgaacttgatgaatgagtctacatataaactatgttcatattaaaatatgatatgtatactgacatcttagaggggaagagaacagctactctactcagtactttaaaattagtttcatgtagaagtcaaccaaaagacaaaaacttatgaggaacttatgaattataacataaagagtattatattataatatccatgtcacgttttttttgtttttgtttttgtgagatggagtctcactctgttgcccaggctggagtgcagtggcgcgatctcggctcactgcaagctccgcctcccaggttcacgccattctcctgcctcagcctcccgagtagctgggactacaggcgcccgccaccacaccgggctaatttttttgtattcttagtagagacggggtttcactgtgttatccaggatggtctcaatctcctgacctcgtgatccgccctcctcagcctcccaaattgctaggattacaggcgtgagccaccacacccggccttccatgtcagttttttaagttttatcaatataaaacttataaaaataagtataaactttatgtcctgacattgtaagtatattctctagggtggttcagtgacttaatatatctgattttatatgaaatagacaaatttaaaacttagtaatttaaaataatatttttgttttaataaaaagcaaagattttattgaggattatatacaacagatggttttggaattctgcagaccttgatttcagtcttgatgccatcactgactttggccacatcatttacttctctgagccttagtttcctcatctcaaaatgataccaacctcttgggtgaaactacctgtcatattgtaggttctcagtgaagattagttccatttctctctcccctgaatcttctcagtaaaagctccttcatgacaaatgtaggttcctttgcagaagcttcctaaatgaaaagtagaaattggtctcagataattaaaaatttctgagtaaagcaagacgtctgtttagctagaaagcaaaataatctctgggtggtagcattatacatattttttctctctttatttaactgtatgttctaattttgctgaaatgaacaagtattactattgtaaaataaatactttgaatcctatgaatgatctacagtttataatctaagagttgatgtgtggaaaaattatagtgattactataactcaatttggaaattttattccttagatccttttatattactgaattggttcaagaaaaatagacctgatagctaccatgattgtgaacactgggaaagaagagaggaagggagattataaataatgcctttttattgagttttctagtacaaccctcttctgcctcatacctgggttattgcagctgtgtcctcactcatctcttcatgtccaggcttcccacagttactgcacagtaatgctcttgaaacagtgatttcatttcacctctagcccgctcagaacctttaatgggtctccatttagttatagctgtccttcacaactgatggtacgtgtgtcatgtaggatgcagtagtccagatggaaagcaattctaacatttgctagtgatgtactctccctcaaacctcacatttatctgtaagtgtgaattttttgtgaattgcttcagatcctataggccataaactgggtctgtgattgcaggtcatgttccgtagtaatcttcaattctgtttctcttgattatatacacacaccccaccaccacacaagaataagtgtgtttgaggcatcgaaatgcaatttacccataatcagtcttcaagtatctgtttgaaaaacataccataaatgacatgcacagtaacagaatactagtaaatatatacatcttcagggaaaagggtgtaataacactcttgatagagtgaaaatacaagaaatcactagcataaagtataaagaccatattctttaacctggtattcaaggccctccacagacagatgccacgtcccttcccaaccttatcccgcatccctcccacgacaaacccattcagtacctcctgagagccagacgctgcagcttgcccttgatgcaccaaacctcatggaatccttgtaacggtgcaatcattatgttactctccccattttctaaatgaggtttagtatcttccttaaggtcacacagctaattgttggcagagccaggattcaaacccaggtttgtctgactccaaaacgggttttctttatcttgttttctggccagatggatttctctgctgagcctcaacctaacacctgtcaagttccacggccatgcttgtgatagcgatgtttatcccagctcagaaaccttatcctacctgttcctcaatgtttaccaccaaacttaactcctgtgaaatctctcaacctccagcctgcagtgatagtgcctttctctgacccctactcatatgttgctttagggtctcacttaatttatcagtttgtgggtgttgtctccccacccaggtaattactacttgatagcagaagctatggaagtctagataatctctaagattctactctttggtttatatttctttttttaagtcacctacagtgctgccgctagcagacactcagtaaaaatgaactcagagttaaactaataactcttcacagatagttagaagcctgtctcccttatcactgagatgagatagcttacagctcagacttaaaatcacttcctctgcgttttgaattaacagtttaatattttttttaaaaaagacaaagttggtagtaagtcaactttgttatcagtttttttttaagagacgaggtctcactgtgttgcccaggctggactttaactcctgcgctcaagtgatcctcactcctcaccctcttgttgttatcagtgtaaaagggctgaattgatagaagataatttgcccagttccattctgttcctcagccttctggacccgtctgcataagagacaatgtagttatatttccactcacggcaaattgcagaaattctaccatgacccccatcagaataactgagaaagaaccttggcaaagagggaaaagaggaacatcgtaccaaaaagaggagtcttggatctgttttctagaaggaggccatgcaggaagagaagagatggtgtctcttaacaggtggcagagatccagggagaaaagaggttttgttcctatgcatcaaagatcagtgtggtcagaagtaacacagtatgtccactaagactacaagtgagtttgaaatgaggctcaaaagaaagaggaaaagttataacagcctacacaaaagctatgtgagcacttaagcttacccctccttcctttcccctcacaatgccccaagtaccccttctctatctctctgccaacatctgatgtttttcattcatcctagtatatcatttagatagaaccacatgaatccgagccatcagttggttttattgtttgcttaaggattgatttagaaatctccataatccattctgccttaatttacactttgcagtgttatagtatgtttagaatgactgataagtaccagaccctaatctctcccaagaaataacaagactcataatttgtaagataattatgtttcaagtgaacagaaagactgtaggtgtgaaaacagctttagtaatgggcataccttgggggaagtcaaaaggattttaacttaaatatcttacgagctaaatcagaattagtaaaacaccagtatctaatagtagaagcttttaaagtgcaaattttatgaaagtaatatatcagaagatgaaatggcttgagcatttggtaaaaataactttttcaaaaagtttaaaaaccttttttgttttgtttttttaaaaaaaatttgttcttcatcagtgcatctcttacattcaggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcaggtaagactaggctttcttatcaataaaataaaaactgccagttgcattttttgaaattattctctttcttaagctcagctgtttggttaactgtttgacgacttttgaatcgactttctacagtagaaagagttttgaatgtagattacttgttctgaggtttttgaatcagtagtgggaagaacaatattttcttcctgatttgactgtttaaaatgtactgaattttgtgaggaacttaatgaatattgagcatcatctgagcacccagtaaaacaccatggattttccaagtgttttacaaagattctatgataatttccgatgatcttattcctttcatgtaatagatgcataacatattcatctctaacacgtattcattctgttgaaaatgtatttttttagtttatgccagatttcctcttagtagagaaatgatgggaacatcaacataaatatgatgacatgagctttatcaactcaggcgccgtgcctcatctaaaatgatcaacgctgagatgaagaggcaagagagctttcagagataaccaagtatgatcatgtcagtgtggtacacaagacaattcacatatccttaatatcaaagaactttaaagtcgtttcccttgcataaaaatcccctcacaacagcaatcacagatggagaactgctggcaattccacagcctttttcataatctaatacagtaccgggtcatagtatgtaaactggaaattgtcgcttaatataggtttcatcatctctaagagaagttatttaaattacctaccataaaattggaactgagactttccccaagatcaactattacgttagtacatagaggaatatcaaaaatgtaagagttgattcattaaaattgacagtaggatgagcctaaagttatattcaataatcagtttatttacctagagaatttcatgctgatttagtgtgacttataaaataagggctggagagttttcatgtatgctttatatcatataattttgtgagaaatattttttctataacctaggaacataaattatgaagaaaagttatcacatattaataaagaaattatatctttaaaggaagatgagtaagaagatttcaacatgctttttctaatgtaattgtggatttagttcatatacatatattaattttatggctgtgaaatttctgaatatcaggctttagtgtattcatttttcctatttaatatttttaatatctatattattaaagtaaatttgatccttatgcattgtatacttcttataatgtactaatgcccaattttaaattttatatttttgtttgtttgttggggttttggtttttgtttgttttgttttttgtttgagacagggtctcactccgtcttccaggctggagtgcaatggcacaatcttacctcactgtagcctcaacctcctcggctcaggtgatccttccaccccagcctcctgggtagctgggactacagatgcgtgtcaccgcccccggctaatttttgtattttttgtagagatgtggtttcaccatgttgcccaggctgctcttgaactcctgggctcaagcaatccgcccaccttcccaaaggactgggattacaggcatgagccaccgcgtctgggctattttattttattttattgtttgagatggagttttgctcttgttgcccaggctggagtgcgatggcatgatctcggctcgccacaacctccgcctcccgggttcaagtgattctccagcctcagcctcctgagtagctgggattacaggcgtgcaccactatgcccagctaattttgtatttttagtagacataggttttctccatgttggtcaggctggtcccgaactcccaacctcaggtgatctgccctcctcggcctcccaaagtgctgggattacaggcgtgagccaccgcacccagccagtctagaccattttaaagtttagatttgactccagttcatcttataggtgacactgactaggatataataaccagattttcttaaggctaggcacagtgacttaggcctgtaatcccagcaccaggaggccaaggtgggtggatcacttaaggtcaggagttcaagaccggcctgaccaacatggtgaaaccccatctctactaaaaatacaaaattagccgaacgtggtagcgcacacctgtaatcccagctactcaggaggctgaggcaggagaattgcttgaaccctggaggcaaagattgcagtaagtgagagatcgtgacattgcactccagcctggacgacaggagcaaaactctgtctaggagaaaaaaaaaaaaagcagattttcttaagtggaagtcctctataacttcaattatagtagacagattggatttatagcaattgtccagtgaaatatgaaaaaatattttcccactgaaaccgcatatgtgattatttgtgtataattcaagaaatatacctctaagctgagcacaatagtaaacatgtaacttacaaattctagaaaataatttcaggtaagaattgtctattgtgttgtgtacttgaaaggtttatttaaagatttagttgactgcaagttgtatataacatttaagattagagaaatgaaaggtgcagtttcgggttttctcataatccttctagtatttaaacacaatacatgtgatatcctcttttcttttctaccacaatatatgtgtttaagtaggttatgcattttcttaagcttcacggttattatagtttcttcctgtggtttattcaagatcagcagagcaaacaactgtttctgagttcagtgtttaaacatgaaatattgtataaggcagcccaaattgaacatttctctgtttctggagaacattaaataaatcaacctgaaataattaaaattggccagccattcagaatagttgcttgagctttcgcagtctttgtgaccctttgtaaaactgcccgtttgattgttgccaaggaatcagtgggctctcttctccctgatgccagttcattctcctggtcagttagtggcctcaggagtcaatgcagagccttatggtgaagtatactgtagcattttagtgcattcacatgaaggctgttgtcgaataggagttggaagcctgagttctagcataccctcaccaccttttcactgtgtgaccttgcagagtcccttctctgagccttagtgtccattggtaaaatgaaagagttggatcagatgatctgtaaaatctctttagtctctatattccaattacagcaagactgtgccactaccaaagagttgatgtaaggacacagttaagtattcatagattctaagaactcatcgttttagtaacggaattgaattaaacatataatctaacttcagaagtgaactaccaagataactgaaacaaaatctatttgtttttaaatggtctattagataatcagcataaatacaacaaacatgggcaaacttttcttctattgattttccaaaagacggcttattaatacattgtagtttaaagcaactttaaatgaggatttttaaagcgtgtatatttggtaatattaaatcgtaagaaaatgacctttaaacggagctttcacactaaaattatctcactttatatgaaacctgtatcaagtataagctttgtctcacgatggctcccgcggactagtgcaattgaagagttagccccaagaatttcttcctaaaaagagcataaggtcctaagactcctcttctccccaaaaatatatctgcatctccatcttagaaatattacaaagcaaaactcacatttgcccttaagtgaccactttatgccctaagaacaaagattattaagtatttttattccttgtaatttggtaattttgggcaaagatggttttagtgttaaagtagggaactttttttaggtatttgaatcgccctcctgaattcatgtgcgaaacacttctgcagatgagcctagaactgggtagatactcaaaacctgtcagctcctcctccccaccatcatgcccactaccctggccttattttattgttcacagtgtgatgcgaatggttatttctatgataaaggtgatggttgtgcttttgccttgaaagaccagctaaaactcaaaattcctcccgttcactttttcagttaccgtgtttaatgttagggaagaaaaatgtttatatgcttcggtcataaaaagaaactttttcttgtctctttgccatgcaaatgtgtaaatatttaaacctgatgaggaaatgaatggcttatttgagacagagtcaccattcaaaactgctgaattaattttcctctgacaattctagaatagaattccagtcaaattttataggtcatgtatccacaccagtcagtattttcatccttataaggtataaatgaaaataaacatttttgactgctgatcaggttatactgtttttatatatttctcacagctgaattctgttctgatgaaactacacaaaagaacaaaaaaaggttttacttataaataaaaattttagtaagtcagaaactgaattagatactctaagttctctccaatattaacagtagaggtctatggtcagtaaaatggcaatatatttaactgtgattctcagaaattccaacaactgattttattccagtttgattggattaagagattcatataatctttttcttaaataggcctctgatgaaattccatttaagaaacctatcagaaagtagaatatttatgatttatatatgcagtagtataataataattatttatatatagtactatggcatatgtttcaccataaacacacttcaggaatagaatgaaactaggtaacattctatagacactgaatcactctacttttaacaattgtaatctaaaaaactccttgaaactacattggaaagtcttttcagtgtctttcaaattccctgtattatttctagttacaaaattttaccccactatattaacaatcacattttatacttttaattcttttttaaactctccagtcaccaatgttcatgtctaattttactacaacaaaacttaggtttaatgatgacccattcataagaataatcaggcacgtttactgttactgccatcctttcagaacccctccattgtttaactgtttagatcaaagatgtaaaggcatcttgttacatgtttctaatctaacaataactaagtaaagcccatggcgttctccatggtgcttgagatggtcacatcagggtcacaagagaggtggagtagggtgggaggaatgaccccacttggagcaaagtgctcttgagttcacaagccaaccccaccattaccagatgtctgagagcctgctaccctcctcaagattcagattccttcacctgtaaagtgcaaatgttaaagccttcctacgagggttcctatgaggaaccagcacggagtaaggattcaacagtagttgttgctacatgaatgttaaatcagagaagactgtacagggttatcttgtggtctaactaaaacaaggttgctggcaacatggatggaactggagctcattgtgtgaagtgaaataagccaggcacagaaagtcaaatactgcatgttcttgcttatatgtgggagctaaaaaagtgaatgagcagaaagaggagaatgatggttctcagcaaactaacacaagaacagaaaaccaaacgccgcatgttctcactcataagtgggagttgaacagtgaggacacatggacacagggaggggaacatcaccccagggcctgtcagggtgtcaggggctaggggagggatagcattaggagaaatacctaatgtagatgatggattgatgggtgcagcaaaccaccatggcacgtgtatacctatgtaacaaaccagcacattctgcacatgtaccccagaacttaaaataaaatttaaaaaaaagaaagagtagaatgatggataccagaggccgggagggcactcaaaatacgtacgactattatatatcaattatgaatttaatgcattaaaaataagcctgctggattggaaatgtcagttcatgtagattttatgtttgtatccccaaactgcctaaactcatcaaacttttgatcagtcagtagaattaaataaatttggaaaccatattgcccaataagggaaaaaaatggtccctgatgtttgaatccagccctgtgtggcgaatagtttgcgtcctccttgtaaatgctatgcatgggagacttctaccatttggacctgtcaggaacttctttctaacattgtatttgttagagcaaaggaagacagattgaagagaaaaaaaaaaagagagaagcagccaccctttatctttctgactatttttcctcgtcctccccccagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttataggtaagaatagtcttcaaagcagcattttccaggctatagcctaaacgccgtgtttaataaaaactaaattatctgtaccaatttggggtaattcctagggtgttaaagcccaggtaaaatgtgagaattatttttaaacctttatttgggaatatgtgacaaactgtgaagcactgggagaaaatattttctggaattaccttgggagaggagaatatgtcatgaaacactttgaaaatctgcatttgaagtgacagtgctttgctttactactcaaattatctagcataaatgaagatcaaagtgataccgtttatcttttgcaagaggcaggctatacaacaagtgttccttctttcctttttcttcagagtctgtggtggaatgtccccgaaattgccatggaaatggagaatgcgtttctggaacttgccattgttttccaggatttctgggtccggattgttcaagaggtatgcaagttagattcttctcttaagccgatataaataagctgtagaaacacaagtgattccaaaaactaccgagacaggaaagaaagggggggggagactggcatattgcttgttccagcgatgtgtcttttctttcggaagctcggtggaaagtgtggctgtaattcttctgtcgtgtcttgtttcacagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaaggtaaacatgtcaatattcacagaagtctgttgttatcttcataaagaaacagattgtatctgtaatctttagttgggcagatctcttttatacgcttccttttgaaagcaattttgaaaaatccatgtttatgaatgcattgttttactaacattttaactaataaaaagaacaagcaccaaagggcccctttgctctttttcagcactgtgaatcattccttttcttcactctgagaaagcaagcaaacctttatgccttgaaactaacagcggacggttgattttatttttctttttatagttttttacattgatgccagcttctaaatctagcattttgacatctctagaaagacagagtagtacacataatatgctacctaaaagaagtatgacatcatggatgtgttccatagctgtatacgtataatgatgagagtcgagataccatactgtaaagtgcaggtgaattgttttttcagaaagcaaaaaagcaccatttccattcttcaatcaaattgattttattgatctgcacacacaaagtaatgcaattaagtctctggaattaaattttcaggccattgaccctacaagtgtaaagttttattgagtcaaattgctaaattaaatctcgtcatctaaagcacattgaagtgaattaagaaggatagagagtatgcaactcatttatttctcaaacagtgtgaggatcccatacagctgtcagtactcagtggtcacagattttgttatagagaaggcaatacttattactctgtgattaggcagaacagagagcaatagtctgaaacctcaagagcctgtgtgtgtaattcaggaaaattacaaatccttgcaagagtctcaattacctaaatggcattaggctggatcttaatgctttattgtattataattctttgcattttcagaaacaagttcttgaaaatggtagataaatatttgattttccaaaatgttcatataaattagattaggatttaattcttttttctgcatgcactatgatatcttctggatttaataaaattgttcttttctttacaccagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacggtgaggttaataaatgcagtacaatcgagttgcttaatactgtttggctaaagatgatattttaatctttaaacctccctttttaaacctaatacaaattttagtaaagtgattctttatggaaataaatattaaaagtaatgatatgtagttgccttataaaaaagaaggaaccaggcttagccagtttgtcactaaaatttcccctttagtattatgcggagactcatctttcatctgcatgagataccatatcttcttaactctcaatttatggaactactaaccaaaactaacctctctaaaatcttaagtatagcttggggatttaagcacattatcttataaacagggaaggctcaatttaaaaaaatcatttgacaatataaggctaaacatcacagtaaagagtatacaggtatagacattatgatatgaataaatggttcaacactgagtttttaatcataataacatggttataatagaaataagacaaggtaatttcattcaatcagccaagttgttattgagcacttactatgtgcatggcattgtgataggccctgtaagactgaaagacttaacaaatcgtgtctgccctctagaacaatggctttctaattttttgaccttgaactatcatcatgacctagtataagtatacatgcacatactcacataattgaaataaacattttacaaagtgatacacgctgatttttttcaagcctattttatttttttcaaatgttggttgcaactcatgagctaattccataactcataagttatggtttgagaagatgccattctagtgtggaagattacagtttatttagggagataagatgaatacatatgaaaaattctaaatcaatacatcctagtttaatactatattgagtgttacatggaatattatgctaaattcagtggacattcagaggagtgattctaacttaatgagtattcagagttttcaaggagacttgtattaacatttctttatttaatgatggtggtagtctgggtaagggtataatttttggctaggtgaacagtattagaaagtacttaagagcatggactgtgaaatcagatgtgtggattcatatccaatctgtactccttaagagctatgtgatcttaggcaaattactatatgcctcagtttactcatctgtaaaatcatgggacactcttcacaaagatgctgtgggaattacttggaataatatatataacatagttagtacagagcttggctgataataaattctaaagatagcttccaccaccatcatcactaccatagaacatccctaatctgaaattcaaaatgcttcaaaattcaaacctttctgaacaccaacatgatgctcaaaggaaatgctcattgcagcatttcagattttgtattttcagattagggatgctccaggggtatttattctgcaaatattataacatctgaaaaagtttaaaatccaaatcacttctggttccaagtaatttaaataaaagattagcaaagatgcaattgtgagaaatatcattatattcaagggacagtgaaaagaaaagtatttggaggcaaaaaaattggattgggcccaattttggggagtatggtttagaaatgatagttttaggcaatggaggatttatcgatagcaataatttgcccactaagacaatgagagtattgtttttggaaaactgtcctgtagataataagtcagagagcatgaattgtgagactttgatggcgaagagacaagctggaggactttcccacaagcgtgaggtgatgacagcatgaattggctgggagtcagtagaaataaaaaagataaatctgagggacatttgaaaggaaaagcagacaggacctgctgaaaaaaacacaatagagacgtgtgttgagaagagctgtaagaatgaagcaaggaaaattggtgctaatgttaatgtccctgaatgaagcaagaaagttgggaaagggggaggctgattgaagaggcaggacgtagggaggcaatggaagagaagtgagaaatagaaaagagatgaattccgtttggatactcaaactaagcaaaactacacagttcatcaaaagaagaggaaaaatgagaaagagaagcagggaagagagaagtggaggaggaagaggacaatgatagaggaggaaggacaagcagaagaaaggagaaagcaaatggattttactagcagtgttgagtgaataaaaacatcctgcttagattaaacataagtcttggcttcagtgaaggggtctatctactttcctgcccacactgattgcccccttctctaagcctgtttaacagtaagtggctgagaaccagaactcagacactgaactgcctgggttcaaattttggactggccccatcacaaaaaaaaaaaaaaaatttggactggccattcactggcaatatgacgttgggcaatttatttaatatctctgtgcctctgtttctttatatgtaaaatggagataattacaggactactttatacagttgaggtaaggcttaaatgagctagtatgtgaaaagcacttagaatagcaccttagacagtaagtgctcagtaagtgttaaccattaatagacgtagtagagggtggtggtagtagttactatggtagaagtattctaaaggctaattgtagttcgtcattcttaatttctcatcaattcagaggagcttccacattaaagcagtgattggacatggttccctaaatgtgaaagttatgaaatgcaaattgtttcctctattagtacaatctaatggcataaaactacatgaaatcttgtgctaagaagctaattcacatgtttatttttagcaagaagtaaaaaggctagtaatttttacaaattgctgtttcctggccttttgagaagcttgggtgacatctctgctgccctatgagtcagtatcagcatgacagatttatctgctactctttacctactacagattgaatcctggaagcccagactaacaaatgtttcctatcagctaatgtataatattgatgaaaattttctgttgaactcatatactacttagagacaagttttcatcctgagttctccttcccattctgatttttgtatgagttttcttcctccttccctccctctcttatctctccttccttccttcctccttctcttcttcccttccttcctgttttattcattctccctcatcttttggcccatacacctctggatagcttgaagaaccagaaactttgtagagaaaattcacatctgctagagcaaataacatgcatagaataaataagagtaaaaacacaaattgggatctggattagagagagccttgaatgtcttactaaagagttttagggtattaccaccaaccaacacttacccagcatgagtgagtggtattattttaaataacatgttaacttgttttgtccgctattcataaaatatattttgtaattacatataatttacatataaaataagcatttagtgttttctgttgagtttttacctacactaaaaaaccctttccacaaaaaatatccaattaaatgttatagagataattacttctatagtaaaggtacttggttcaggtctcttaggcctccatcagtaaaacaggcatattaagactagctgtagaataatacttgcttgaaatactgtcattcagatttgcttcctacagttatccaagtcggaaaggaacaagcacaatagccccttttttcatataaagttattatagtatattacctgaattattttataaagggtagtttgtaactgatactaaataactcaaaagttaattcagccctcttcataaaatgatactgctatgaattggaaaatatacatataaatgttcattaaaagattaaattggctgccaaaaatcacacatcattattttacatatttagacggaatttttttcatgctactgtaattattttggtagttgaaaatctaattttacctgtatactaaatgactgcttaatcatagtgagcagagatctttatcctattcatcttgatatcctcaatgcaaaaaagaaacttcacatatatttaactctcaataaatagagtagtataatgaatataatactctatttttgaagaaagtaattatactaagtatagaaaaaatctttatgaaactttgctattagccacaaaaagacagaaaacttacttagaattcatagtaaaggtctcaaatatgcttccaatcacactgaaaatatctggtcttgtgtacctcaaatttatctggttgttgcacagttctcatttaaagcttataaaagcactgttaatttacatttgtggcttaaagtttacaagcagtataattctgaatttctaagtgaatcctaaaggaaaacactttactgcctacctcttttgttgatgtggaaatgaccttcagatatctaaattcaataagagaatagactttacacccgaagaaacattggttaagctgctaaaagagaagaaatgaattatttccatctgaaagtttataggtttgaaagcaacagagctttcctctatcttcaacagcagtttgttcattaattagcccttcaattccacttcaattaaattaactctaattaataagttcattacaaagattgacgcaccttgctcaaagctagtgtgctaaatgctgataaacaccatcaccctaatgaaaaattgattagattgaataaaaagggtacctcagaaagaaccctctcacttctggagctgggttgatgttatgttgctctgaagttaatcaaactatcttgaatctcttaatcaaaagtttaattcaaaggagatagaaaatattgcatgaaaaaacctgcgtgctaccctcttccagttaatagtcctgggtgttgtttataaaaaatattacaactctcgtagtgccttgataaggtgtttagcctgtgagatagagaatcacgtgtctgagaaatgttacctggggaatgaatagggaaaacagaacatgtgactacataaacagctactattttttaatcaaaaaaaggttttagtacattttctgtttgttagaaatgattttaggtttttattgttcagtgctttatttttgtaagaaaaccaaaactaatcaatagtcttagaattttaggggaaaaaactatagctaactttaatcttatatgtaaaaatgaaataaccttcaaagtttcttttacctttgcctctccctgtctctcaattggaactagttaaataaagcttttaagaaagcttaaaattttttttcttacacatctgaattctttttaaagacctaacctggtattaaaacatttgaattcatttggtcacttgtgctcttttcagtaattctaggaattgaaaaaccttgtttttcaaaggagagtcaattatatgtattattaaactggttttgtactgtggactaagaaatttgtatctgtcaactgtacaaatttactgaataggaaaaacagtttctttttacatgcatgtctgtgtcagaagcaagctaatttacttaagtagattcctcttagtgaaagtttctgaatatttaaaacatttaaatgtggcattagaaacaaccccatttcaaattcttgccatatgtatgaaatccaagtcctgttagatacctgagatgctgaaatatttcattaatttggggatgggggtgtggggacatgttttcttggtgataggtgtatataaatatgaccaccctctatatatgtaatgttttctatataaagtattgtatatgtaaagaaattatttctaacaattgtcatgtgtattttctgcatgattagagcagcatgtaaaattaaatgatgaataaagacgtagagttccaccattgatcatttcctagtagtcagtgctgaaatttacgtagcatacaaatacttttgatttcttttggatgattttgtgtttcccttgaacaaatttgtgtggaagataaaagctgcttattaattccccttctctctcccgccactcttctctcctgttttgtgtcctcttcctcccacatagaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcggtaggcttactgcaagtctgtgtctgtccccttcctcccagagaagagcaccgacggtcagctgttttcaacttggaaaaagcctatttctttacgttattttttacttgtctttcttaacacgaaattattttttaaatatggttgtcattttataatggcaattcagttctttttagaacagctgtcacaagtatgagctataaacttttttattcattggtttttgggacggccacaaaaatggactcacataaaacagacttaatgatttgtttatgtgaagttttatcgaatattacttcttgatgttccatattgtcattgcatttcttaatagcagattttccactttagaaaaaaatgctttaaatttttttcaaatatatgcccttgttggcctctgtagtttccagaatcacatagcttagacttgtccatatcttgagtctctgcaaaagaggtttgacttattatgacttcattttgtggtatcatgagaaataaagtagaatcaaatgtacaaatctcgctgctcttaaacaaacctgtatggttaacactttttcatatatgatgacatttgtgaacatctgtaggttaaataaaaccatcagatagatgtttcagatcaaaacattagtatataaacaatatttagcatagatacaaaagtatccaaaacatatatatcatgttttcaagatacttagtgtctttgcttttaccatttgtcactaaaattaaaatgtttaattttaaaagtacaacaaaagtaagtaataaatttctatatcacttcagtgaaagtacacagtattaattataagtggcacggtcctaccaaaatttcagaatttgtggtatagtatttctccacattgttttacatccctagggtgaaatttgataaatctgttgtggggagtgtcagtgtcttttaaagatttcttcttccgatgtatccgtaagtattatgtacttcgcttttttgctcacaggatttggttagccgggaactttgtcatgggaaaattgaaatcatatgtgtcttataaattgtcacaagtgtgtcattatacacttcatgtaagtttttttctaatcttactgacatccttgacatctgtttcaagggtcccaccacgcccccacgctggtgatcttcaagaagaactcaggacccagaggtagttgtgtcatggctataatgtatcacaaccagaaagaaaaaagacacatccggcagagtctgcagaaatccatgcacaggcttcctatcttccttctctcccactaggagaggtcatgtgtagcatgctccttttcccagcagcgaaacgaatcgacatatttgcagtatttctgcccagggaagcctgttcgagacttagagcaaacttgtcaaacctgaggcctgtgggccgtatgcggcccaggacagctttgaatgaggcccaacacaaattcataaactttcttaaaacatgatgagtttttcctgcaattttttagctcatcagctattgttagtgttaatgtatgttttgtgtggtccaagacaatttttattcttccagtgtggcccagagaagcctaaagatggactttcctgacttagagtctaagatttttattggggcttctccaggaggtatcctctgtctgccacaaccaccaaaattccaactctcctaagaagagtaggtgtggacaaaataaccttatcagtgtagggaacatccaaatttccagatgccagccaagggccagcccgccaaaatcctgcagatcaggcccactgttagctcttacttgcacagcatccttggagcttcgcttgttgcattggagcttcccgcctgaaatcaacaacaggtgcccacagtcatagcgcttgcacagggctcgtccccactgatgtggctttcccctcccaaagaggctttgtagggcagtggcagcaggttgttcatgtgaactacattaaggcagaagaaagttgatgagcaggatttgtgtatctttttgtggccatacaagggacaatgcaatacctctataaccaaacagctccatgccccaggtcccagaatgcctatataccagaggcagggcaggaaaactatacctctgatcacattccctcattctttgtgactccaccacccgatacccgatacatcagaagaaatgagttgagtctagctgagggagaaaagttatgatctgactgtatgtatcttaggaagtacaacaaacacgtgtgtatagctttgaaaaccaggaagtgtgccaaaaagttatccataggcggatttaacttaccaaccaatagttattcaacaaatcattttagtgttgttctcagtggccttggtattattacatggataatagtttcccatagatgagctgttcttgaacaaatttctagttgtttaggaacaaacaggatttttattagcagtgggtctttgtattataatttaataaaccctgcaatagttcttaacaattccatttcctatcattttaatttattctgttgcttttatactccatatgaataacattgtgggaaataagggacctgcttcatttacaaataaatcttagatgtgaaccttttaaaagatgtagagcacctttaaagcattctgctcttttatactaataagatgagttatttccaattttggcatacaaagatccaattgcctttcccctgtttccttactacctgtgtatatgcccaccatagtttcctggttagggcccttagtggccctacggggccatttgtgagccacagattaaacacccaggaaactctggtgtgttttctcacttgggatggttactgttcttgcatttcctccccattttaacccctacgcatctggctgaaagaagctgccacttggtgaaagaatgctcataaatcagccagatttttttctttctccatattatgtgccatctcattgaataccaaacaggaaggttaattgaaagagaaatggaggagaaagtaaacagaagcaaacaaaaattcccactagaaagcaaaggacattcttcattagtcatcctactgtcttcataaactctgtctatgctttcataaaaccataggcattttgatagtaaaataggttatgaatttggagtgttcactgaacaccctgtctacctgaaagggttctattctgatatttttattagagtattcatattttcctctcattatgaatcatgtgttcagcaaattaggcatattcgtctgcaggttcatcatcccaagtcctcctttcttgggtttccctttgattggtgatgcatgcagatggaaaatgaaacaaggagaaatctacttttagcaatattgtgattaaaatagatacttctcctttcctccccagaaagcattcatgattattagaccctttaataaataaagaaaaagagaagttacatgattaaaccacatcaaataagcaccagtacttactgctaaaatgatttaacagtaatagcaccgatatagatgctccactacaaaaatactctcttttatatgtgaccattccatataagcttcaaaggattatactcatgtgctgccactgtttttcatgggtaggaaatatgtaaaaatatttagaggattcagagacaagttaaaaataaatataatgaaatgttttttaaataatagttgacataataagaatattatctggctatctctatgtaaaaaagcttcaacagttctgtcatctgagagttgaggtaggtcagagaaattgggcttcttcttgcttagaaaaagagggaaaatctcctatgggactgtcctgtggatgcagttagttggccatagatgcaatgcaaatgcagtggtaggctctgctgaacagatggttataggcagagtcaatcacttttaagtgtaatacgaagtaaataacctggacaatgataaatactaagtaccaaatttttactactgctaacctatcacttccacaagaaccattctttttagtatttgttgaagaggtttaccccagaattcattcatttgtatcccagagaattggaggctgtaagtgagattgagaccatagcagggtaatgattgaataacatatttgattgttatctactatggagggttgttgtgaaggaaaagaagactcagctctctgtagacaggcaagttgtcttctggaggctgattggcattttccatttatccaggagacagaaatggagaatatgggtttacaatgtataaatgtttgttagatataatgaagaagctcgagtcagaaagcatatttaaatcctggaacaagctactcaagaaattttggaacctcccaagtaatcgtagtattgttaaagtttaatactatgattacttaggtgtgaaacactggaggtttcgtcagttctttttgttagcttaaggagtatttttagaatgggagttttttttttaacttctctccatccgttatcctaaaagatcaagtctcttgtgtagtagccctatttgaaggacccctcaaggtctcttgcagttctaggattttttcgctgttgataatttctgctttatttggaaaactactagatttaaacatggggttctctttttatctctatgtcatttaactttttgtttttcctatggcattgaaacatagtgagaaaccatcttcactttttcagatcatttggggtttgttttgtgggatgctctactttgcatgcctcacttactttttatttgttaattaattcatttatgtgtccagtaagcaattattgaacatctcttctgtgatactgagaacaatttcttacaaaagtcagtgtaagataataaaaaaggtatgggctttgacattttaaataaaatgtttttaggtcagttttacaatttattcactataactggtatcttttttttcttcttttttttttctttcgagatagaatctcactctgtcgcccaggctggagtgcaatggctcaatctcgggtcactgcaaactccacctcctgggttcaagtgattctcctgcctcagcctcccaagtagctggggttacaggcgcccaccaccacacccagctaacttttttaattttttagtagagatggggtttcaccgcgttggccaggctggtgtcgaattcctgacctcaggtgatccactgcgcccgtcctttagcttttatcttaactgttcttagcctcagttgggttttttcgcaatgtaaaatggctataatagtacatatatgagattttgaagcagaataatgtttaagagctttgggaattgaaattcttgccgtaccactgagtgaccttgggcaagtcatttaacctgttttatatgaaatgtgaatattatgtacttcatgggattattagaattaaatggaatactagaatgtaaagcatttagcaaataatgttcaataaattcaagttttaattttgttattaagtgtaaatgagacaaagtacaacccagaaaatgttttgggtgccaacattcaaaaacaagaacaacagaacaaaactcctgtccaggacatttactttaaagagttaatgacatttgcattttattattataaaatataatctagtctcataatggatattgtttaacaagaaatttgtatgtttgggttaagggtttgagggttggttttatttttttttaattttcatttatttttttatttttgagacagggtctcactcagttgcccaggctggactgcggtgatacggtcacggctcactgcagcctctgcctcctgagcccaagtgatcctcccacgtcagcctcccgaatagctgggacctcaggagtgtgccaccacacctggctcattttttgtatttttgtggagaaggggtttcttcatgttgcccaggcgggctggtctcacactccaggacgcaagcaatccacctgcctcagcctcccaaggtgctgggattataagcatgagccaccgcacccagccgagagttgttttttaaaatcgtgatgatgaaagaaaggtggaggatattgatgtatttttcttctagtaatgtctcaaacacagagttgtatattgagctacattgattttcatgtacttttaggcagttcacttggaaatttggcctaggggaaatcctaattcctttaaactacaaaagagcagctatttgtttttattctaattcttagtacattaggaaacaagatcattaatgatcacaaagacatgctttgtttgctcagacaaaactcacacatgcagtactcagcatcctctgttaaacaccagggctgcccttgggctttgggatgccgaaggttagaaattgagaatgaaatgcacacagctggggaggtatttcggaaacaagatggggtggaaagagagaaagagcaaaacttttactgatacagacaagcttaggcttggtgttctaattcttatctcagataatggtgaaagaatagtactttaattgttaaattaaaaagtaagtgacaaatttgaaaataaaatgaccactctgataagtgcttcacttaaattacaaaactcaatattctttgcaacttttgtagtgtttcccagattgagcatcatatccaaaataaaacaatatgtaattctaaaaatatctttttagattttaagtcacattttgtttataatttccaataacagtggatatggggcaccacatcatacccacaaatagctgttctgggaggcatttggcttcacatcagtcagtggttggtagtggtgatgaaaggcaaccttgcgccaaactaccagcgtccctgaccttgccagagacaggtttactgtgaagctggtgtagcataaatgtcagggtccttcatttgcactggcacctcctaagatcccacaagggaacacccatgggttcaggtgtcgtatgttaatataaaacttgcaaatcagctgacttctgacccttcacactccaacatcctctccaccacacttttccttgtgcagggtggcattggggtggctgtgggcattttgagaattccgataaggagaatttgatctgggggtacatttagtttagatttaatgggatatgcatatgaggtgtgaaatcacttctctctgtggctgttactgctagccacctaggaatcttcctacctcccactgactcacctagtgacacgaaagtacagggtcagggagttactagatgaagatacgactttgtcctgtggagctctgcaccagaagcaagtaggtattggaggagaagtaaggtttgaaatgtatggaaacagaagctagtctggaaaattcctcatgtcatcaaatacctaaaatgcctaattaaaacagaagttttctcccaccaggcatgtacttgataatagaatttatataattataaacatgccatagctttttcttttagatgaatatttctcctttgagtatttatcagaattcctgtgtttgtagggtataagtctgtagcagtactgcagatactgagttcaacagtgtgtgaaatcacatgtgttactcatcccagtgtatcactgaatcacatgagtgcaccagaaaaagtcttgtttatgtgacgtcaaatactgacattgcaaatttaacataaaactcaaaatagtctactctacagacatcacaacaaaatagttaatgagtattatcaactcagcatatttaagatcagtttattacacaataaaaaaaaagtctttccaaacttgacagtaacggcacaaatttacatgacactaccaataacaaattttgaaggcaaatgaactactgttgatagttttatcaataatgaaaagtaaactatcgcatagaatatagactcaattatctctctatactctctatagaaaatattacaaaaatcgttgtcatataaagaggcaatcaaagagtaattatagcccaaaaatataggaaaaatgttcattagagacatggcaagcactgaataaaaaatggatatggggccgggcacagtggctcatgcctgtaatcccagcactttgggaggccaaggcgggtagatcacgaggtcaggagatcgggaccatcctgaccaacatggtgaatccccatctctactaaaaatacaaaaattagctggatgtggtggtgcacgcctgtaatcccagctacttgggaggctgaggcaggagaatcgcttgaaccagggagtcagaggttgcagtgagctgagattgtgccactgcactccagcctggtgacagagcgagacttcatctcaaaaaaaaaaacaaaaatgcatatgacttctctcatgtttgtggtattaactgaaaaataaatgttttgttgcggtttttctcattctaaatacttttatacctgatttcatttttatattttgatattctttttcttaaagagggcctcccaaattatgtaaatttcagacccataaaccctggatttccccctggttccagctctgtcacttcatatctgtatgatcttgggaaattacttaagccccctgtgcctcagtttactcatctataaagtgggaatgaaaatagtaactacctcgtagagtccctgagagtattaaatgggtcaggtcatgtggaagagcacttagcacagtgcctggcacacagtaaacaccctatagatgtttcttgttgttgttgttgctggtcgttggactgaaattcataacaaactgactgtgactaattcctccctgctaaatcttgtctctaggcagaggaattagcctcggctaattcttccagaaaaaacaggagtgcatgctggatacaaggagagctaatcccctctgcctcctggcacatgaatagtctggacatagatgcctcatgatctgtcattcacagtggaaagtgggtcgccaaggaggcagcaggcgtggagttgagggggagattctcctaaactgacctgattggcgctgaaaatctaggggaaattctcctaaattgacaggctgaaaaaccttctgtgaagcttgcagaacgagaacttcttgaggtccctcctgctctgcaagtcccagtgattctcagtaataagaaatttgatggacagaggggatagagatccctgagagagtcatggaaagcccccttcagaactcgggagtatcacccatgttctgagaaccgggctgatttcggtgtctgtttcttccattgagatgacagtatccactggcagctatccactgggggccttccaatactgtttttctcattttagtctagtttcttcagttaacagttttataaacactactttagcctctgtaatcccctcagacttgtaatttttaaaagaagaggtcacttaatctcttttctacaaatgcaaacctggttcctctgacctttctaaaaggtggaggccctgtttggttgtcagtattctctactgtttcaatatttttaaaactactacaaagataatgtttattttgatgttgtaatctatgttgatgttgcagtttgtctgtccttcaaattcttctttcgtatttgcttgtctttacatacaccaatttcatcaaaaaaaggacatggagccttgggttccgcttccttgcagccagcattgagagcaatggcagatctgcactctgagccaaattcgtctttcgctcagtgttccacagcctgttgagtgagagagtaatcaaccaccaaaaacaaatttagtggcctaaatttgaaactttagtaagtttgactctgtgtttctatcatagtttagccttaaatactacctgccaagggtttatgaaatcattccatttctactgttacaatctgtatactataaagccccaaaggtggtagtaatttggactcttctaccaacctctggtgaagtgtgttacagatttaaccttgtagtgtccctccttccttatctccttcaccttcccgtgtgagtcatacgatgacgtctccaaaagtcccattagaattacaactgcaactcagtttacagattacatcctcaaaaaagtaggtgagactcctcactgacttctgcacctgacttgctgtgtaaccgtcaggaaaagtcacagtcccgagggccatgtggatacacgttctccagtcatgttggtgatttattttccactaaagaatttcccaaggcctcggtttctgtcccttagaatgggagtaagtgtggggataaacagctctcactattgacatcaggccttgagttccctctttctccaccctatccttcatgccgtaatttatcctcatgaaaaagacaggcagcagcatagtcatcagctagagctgcgtggtttcatatcagacggcagtgccagtgctactgagaggtaaatttctaggacaggtgtgttgttttgggaaacgttagatgtgttttttccatactttagaaaaggaacattttttgaggccttctgagactcaattctgagtgtaaataattgcttggtgggtgaatacatctggatttaacatacgtttttccactgaagtgatttacacatagctgtgaggatgagaagttagaattcttgaaaagaaatacgcttcacatactcttcacgtccttgtttagggtcatatgataaatgaattctatactgtggtgtttacttgtgcaggaatttctttccggtctacctcctgtggtctaacttgagtcccaatagctattgctaaattaagctttctcctacaaggcccactggaaggcgggcccactggcattagaagcagctgtttcagaaagaatggagagttaaacctgttgtgatttttctcaactgggagcaatacataagcaacttgaggatttgtattgttttttgataagttagatgtcattgaaatatgcctgattcctttaggcttggcaaacccgattccttcctttcccaggacctcgtgtttgtttcccactgtgaaattaatggtttgctaactagttcttttaagtctcaaaacagtttactgtgtagtggctctgtgtcttagggaaacaatttataaattataattattatctcaaggaaatttttgaatccattaattttaattacagttatatgccaggccagaaatttaaaatatgaatatagccatgtattcatgcctgtggtttccatttttctttctgaaaccgcatgcctcatgttaagccaatataagttgttttttaaaaagtttattgagagacatgttatctgaataaaagccgagtaagtgatatgtcaaattcatatgatactgtttcattacaaacttgacattttgttcctttactaatatactagaggatcttttttccatttggaacacctcattaatttgtatcttttaaaaaccatctaagatctaaattaccaccgaaaccgagtatattggaggttttaaagctcagttgactggatatacaatttaaccagaaataaagatagaaaatgctccttctgcttgccaagttcatcagaagccttttattgaaaagtttagatccaaggcatttaagagtgaaaccagctgcagaataatatgttgtcagctatttcacaatatcagcaaggaagagaaagattctctcgagttccagattataaggatgccacatgcttcccaaaagtaagccaggtaactggagagtgaaaggcagctagtgaggtgtttatgaggctttgaagtaatattccttatatgctgagatccttattacctaatggggtaaataaaatgttgggacttttcattcagtttaatgtaagggtagagaaattaagcccacaattttaagaagtatgattatcccttcccacatggtatgttgttatcttttcaatggcagaatttatctttgccatttcttgaatatgacaagttgaaaatagcctcttttcattttaaaacagtccctctcccacctccctattttaaagtgcaagtttggttgtggtgtctgtccatacggaagcacagccttccagcagccttcgtatttaacatattcgcagattatggtgtgactggagccaatttttgtctgttgctcttcatgataagttcagtgaccctctcttttttgagtgcctctttaatgaagctggaacccagctgtctgaaatatgactatcatttctgggatttaacaggcatgtaccttggataaattaaggagcagtcaaaggaggtccataaatttgaatactttgccagctgcttttccattaaactctgttggttgaatgaaattagtaaataattatgttggtggggaatctactacatctaaatgtgatataatgtcttcctttaacaacagagcttaatttttcttatatactaaattagtttttagggtaatctacattgcaaattggtcaatttgcatcaaaactatgcctagttgttctgatttgtcaacacctctttttaaaaaagtctttaactttaagcatgggtgggtaagaccatctgcttgtagagctcgcctgcagctccaccacttagtgcacgagacaggttacagctgcttaattgttatggtgttgaatgattaccattctgtccaaaattaatatttatatatgtgtccacagaaagcatgtggttaaacataagcaatctaattgtgaattaatgacataaggtattcattaatgagtccccacctgaacaataaggggtaaaataatgcttttcacatacagtccaactcttgacttttttttttttttttttttttttttttgagacagagtcttgctctgttgcccaggctggagagcagtggcacgatctcggctcactgcaagctccgcctcctgggttcaagcaattctcctgcctcagcctcccgagtagctgggactacaggcgcccacaaccacacctggctaattttttgtatttttagtagagacgaggtttcctcgtgttagccaggatggtctcaagctcctgacctcgtgatccgcccacctcggcctcccaatatgctgggattacaggcgtgagccactgcacctggccccaactcttgacttttaagatgagtccccagtagtgattatgtatgtgagtaatccactgcaatacattggtatagataaggaaaaaaatcaccatgtagctgccatgaaaagcaaagaggaaactatgtggttatttcacttactctaactcttccctgcccctacaagcgttgtcctctgaattgtgaccagtgtaagaacaaaccgcatagcaaaagtctagatatgcaattatgactacatgtttgtgtgccacccacagctactagaaaggattgtctcagccaagggtggccttcctcctgtatttaagaatggtgacatataaacttacaccattctgctatgaaaagttagcaatatatatcctgtctgctcagtatatttcataatgaaaaatctttagcaaactcacaatgtaaggatagggatatgcatgtaaaatataatatttgaatgtcttagtttccaaatagttactgtaaatacatgacttgtatttctgaatttgagtggactatatgaatatttgtgtgagtatctacacttttttagaaaagattaatttatcttgctcaaataaaattactagtgaaggagcagaaaatatataagggcaagttgtgatgtgttctttattccaaaaagctgaaccccatgttgaccaggaattgtgcatctaaccagcagagggtttgtgagagacaaggaagaaaacttcctgattccaaaatggagttgtccctaccctgggaacaggccagttcatataaagaatgttctcagcaaaaggagggcagcttggggaggcagagtacaaggggcttctcctgctggtatggagcagaatggaccctggggcttatgaaaccaaatcattgccaatcccacatttctttcctcaaagtcagactttttcttttcttcatagtcacttaaaaaataccagctccctcatgagtttgtcctttttaaactctccctattaataagatgaatcaataatatttaatatgtattgagcatttactacttgctaaggcccaatgcaaactgttctacattaattatcatgtttaattctcaggtagaagctagtaaaatctccactgaagaaactgaggctccaaaaggttatgtaagttttctgtggacgcacagctagtaagcaacaaaatcagaaccatgtgagcgatttccaagcccacgctcttttttttttttttctttttttgagacggcgtctggctctgtcgcccaggctggagtgcagtggtgcgatctcggctcactgcaagctccacctcccgggtgcagccattctcctgcctcagcctcccacatagctgggactacaggcgcccaccaccatgcccggctaattttttgtatttttagtagagacggggtttcaccatgttagccaggatggtctcgatctcctgacctcgtgatctgcccgcctcagcctcccaaagtgctgggattacaggcgtgagccaccgcgcctggcccaagcccatgttcttaagccctagatagactgtcctgcctcctgaattatttttcaattgttcttgtgtgtatgtgtatagtggaatagatgaaaattaatttttatgtgttgaaaataaattaatgtatatgtccctgtcacaaaagattgaattgtcatagaaacagatgcaaaaacaataatgccggtgatgtcttagtaaagtaccacacttttttatccaggaaatgttaaatgatagctgataacagaacttgtaatttgccaaaataaaaaataacaattacaacaacaaaaaatggtttgaggaaaatcagtttatactgtggaggatttaagaacattgggagctattgaacactctacccacttcctttcaaaatttaaattaatgtcctgttttcctgtcactggaagttagtgggctggaatctatgtagacattagccaatggaaaactctcatagaaagtgggtagattatttgtgtcaccagcatcagctcatgagaaaaggctgagaaaagtgtatacaagtggtaaacatctttgcatactctcacctacaaatacagcaaaattactttctatatcaatcacctttgagaacagccatttgtttactattttcataaaataaatcataatgtatcctaggtaagttaaaaggattgttcagttttgtttattattttccagttatggtcaagaaaactgacatgagaaagacccattatatttttcatacgtaaaagtgttagtctatacatttttcttaaatattaaatgttgtgaatagacaaaagtggcaattacagacaaaaaattctacccattgatattgcccagatctctggatgattgttctggcttcctgtgattggatttattagcactatccagacaccactgtaatcactgttataaccaacttcatttttcctaaatcttaaatagccaaatattcacctagtataaaacattgtattatagttttttttaattaatgttaagagctgtctctgactagtttcattaccaaattggagtactaaaatataccttttttttttaatctaggaaatcctaaaatgtgttttttgcttgtgtcattcaataaactcacacaaggaataaaaaataagggagatgtgttactaacacgtgtatgtttatggttcagtggatgaaatcatcccacatgcaaaggctaccacaaaactcatacatcacacaccacacaaggcatctctttgcataggctatgcacatcccaacatcagtgagcctgccttctgcaccttgagtgttccactgttacttccattatgtgtatgtagtccatggtcaggcatgaaatcctaaattgaaggaaaataccaaattctgttctaccagtcatctctacaaagctctgcagcttataaaggcactctttcagcagtgctgactttataaaatgtgatttatctcaaagcagctcttccatagaatctggatttttctgggctgacttaaatcaggaaaaatattatttctctcgtttggaatgccttggtataaataccgttccaagttgaagtatggtattttgcttgggtaggtgcatgtaagaggcaatgtagttattcagataatttttacaccaagtttccaaactgtaaaaagaataaaatatgtaaactttcaaaagcagtttatttgaagcaaatttttgaaaaagtattgccaattgtaggggagcagatccctttaaagcacgtgtgcacacatgcatacacacaaacttttttttttttttttttttgctgacaccacctcacttactagttggtaaaatgcaaattaattgactttcctaaataggaaagaatttttttgatgtttgtccataatctgataattctgtggtgaaagagaacatattttaaggagtcttgagtaaactcttaagaatatgtaattgttttatggtgtttaaaattatgtcactgtcataatcctttatggtatggtaatcagtaataaaacattgcagtgagcagcagttaaggaacatcaaatcaatgggtgtgcaccttgcacgctgatttaaacagttgctgattggaataagtggatttaatatgtacgtatttgtagactgtagcttttctgtcatcctgcaggaattggtacttgactaatctgagaatgatacctacttacaactttaatgaggtactaatgtgagtcattttttaagtccgtgttcggaagtattatgaaatgctcaatgctaactaaaaatctgccctctactccaaggacttcacagtaattatcatagtgaagaatatgtctgtattttatgatgtacgtatctgatgtctacactataccgaggattcaagccagtagcccggtgaaaatattatacggtactatttaatatgcctccaccaagcgcattgttgacagcggaaacaatgtgagttgttcatagccatacacatcagcaactgcttatatacagtgaaaccgacttgaccttcccttgtgagctacctgacgtctatataacccgcttggtttgcctttgttgcttctctgtgtttatgagagtcagcctgatggcaaaaggaagcaaacttggaattaaccttgttccatgtctcagccggacaggaacatatactccttagacctcatttttaaatgagctgccttcttgggaactactactcagcagatatttctcgtccaacatttgtacatccattcaactgcttctggtctttgaggctttttggtttctggttttttcaacttacttgtttttatttttcctggttttatccctagttctactatcttgcccactggttttccaaacttcggattttttagaacagatgacagcattaaagctttctttagtttatataaggtactgtcatttatgaagcggtgtcatcagataaacattttaaattcattcgggttttaagcttatttcctttaactgtcagtgttggaactaaggatttccacgttgtttagtctgattttttttattccagtaaattccttgggaaatctataaacagatgatgcttctagttcgccttacacaggtacacagttctggttcttctgagttgtaactataacgtttatttagaatatggattttggtgtcagactgcctggttggaactttgtctttgccactgctagcattttgatcttaggaaacttctctaatttcttgtgcctcagttgcctcatttgtgaaataagggaagataataatgtacctgttaccccacagggtggtgaaaattaaaccggttaattcacattaaatgcttaggagttttcagcacataataaatggtagttattgcgaataccactgtccatagttagaatacatgggaggggagaggaacagatgggtgaaggacaggggaaggatgttgtaaataaggttttgctcacttttgcttctttctcaaaagatggcctctgtattacttatagaatttcttcaaaagctgcagacacatagaggacatactaaggccaccaaaagtacatttggtcattttatatggtcattttatctgctttaatataaagcagatattaacactctgctttagccaggcacagtgactcatgcccgtaatcctagcagttgggaggctgaggcagttggatcaccttaggtcaggagttcaagacaagcctgagcaacagggtgaaactccgtctctacaaaaattagccaggtatggttggggtgcgcctgtagtcccagctacttgggaggccgaggtgggaggatcacccaagcccgggaagttgaggctgcagtgagccaagctgtgattgcaccagcgcactccagcctgggtgacagagtgagaccctgtatccaaaaaaaaaaaaacaaaaagactctgctatgagccaggcagtgggaatgcagtgatttacgtggcctagagtttacctctctaatggggacgatttacacattaagtcacctatgcctagaaaggtcattaaagtctagtattttcatggcatctgttagtagaagtgaattcatcacggccaattcttgattgttctcttttcctgttacatgcactttgatgtgcatactcctagaccttatccaagagaggtgctggggtagagggaagaaaaaggaagaataagataacagaagagatggaggggcgcccagaatgttgatagataagcagatgaggcaacagcatgaagatagaattccaaaaagatgctattccttcctgatctgtatgggaggaatgaagcatacaatactatatatgagtgaggcccatcctcagagacctgagagtccaggtccatcactaaggggtgcagaaaagagcaaattatcttgtgtcctcctccacctatctttcccaaaatacaaaggaggaaatatggcaattaggggctttacaaaaaaaaggaattcttaaaaagaagcacctagaggggagatgtgtgaaaagaatacaggagtagtcatttgctttgttgatattgaaaatttatggactaaatatataatataaacattttcgatgagccacatttgtctttcacattcaaaacttccatgagtctttgcctacctgtaccagcaagtagaccaaggacccgcaggtcataggcttgaaacccgaatacttgcctcatttgttatgttccagggatggctgtgtatctgaatgtattttgaaaaacagttaaggccaagaattagccttggcatttagagtaatctgtagatctgccttgtgctttcctacggaatccatgtagaagccatgtaaaagaaggtggaactgcctggtggctttggagaacgaagtgtctggttctgagctcctttcatcagttttttctactggggggaaaaaacacctttttttttttctttttttttctaaatctccaagagacgacattgtgatagagtggtttagagcaagctctggagccaggcagcctaggttgccaaggtgttaccttgcccaagttaatcactcctctcctctgtttcctcatctgtatttactgtctcaactgttattacatcatagggttgtggtgaagatgaaatgagagaataatatatgcacttagaacagtatttggcacaaaggaagcctttattattacctacagcgagcagggctggcggcaaagtgcttcgtgtgtgtccctggatcattctgaacctggtcagagctacgagatagaggcctgggccagagctagaaatttaggaatcattaatacatcagccaggtgttcataatctgtacattacagagccagggctcatggaagagctaaaatcaaggcggcattttgtgtttgtgaacatatgtgaatttttctgggaagagaacccaaaactttcaccagtttactcaaagatctgagacctggcggggcgtggtggctcacgcctgtaatcccagcactttgggaggccgaggagggtggatcatgaggtcaggagatcgagaccatcctggctaacacggtgaaaccccacctctactaaaaatacaaaaattagccaggtgtggtggcgggcgcctgtagtcccagctactcaggaggctgaggcaggagaatggcgtgaacccgggaggcggagcttgcagtgagcggagatcgcgccactgtactccagcctgggcgacagagcgagactccgtctcaaaaaaaaaaaaaaaaagatgtgagacccagaaaagagtaagacttgccatctcacaggaaatatggtcctactcatgccgtgtgtcccacgtgggtgttcttccaaggtaaataattgaaactccagggaaagtattttatgactgcaacattttactagaaagcagtgggtttttttttgttttttgtggttttttattttgagacagagtctcactttgtttcccaggctggagtgcagtagtgcaatctcacctcactgcaacctctgcctaacaggttcaagcaattctcctgcctcagcctcccaagtagctgggactacaggcacgcaccaccacaccccgctaatttttgtatttttggtagagtcggggtttcaccatgttggccaggatggtctcgaactcctgacctcaagtgatcctcctgcctcagcctcccaaagtgcaaagattacaagcataagccaccgcatccagctctggaaaatagtttttttaatggttcccattttatatgtctagcacccatttttgtaagagttttatcgtataaaacaaatttcaacttcttagtagattgaaggaatgacttttctctagtgtcagaacatactcgttagttttcaaagtaattttttgcaacctaatatgcatttcagcaattgttaggtacattaatttttaaatatgctgaattgtttttatgattattatttctaatggcttcttacaaaatgtctgcatttttttatttcctattgtggtttatataatgatgtttatattgttgcaattattacttttaataattatttgaacctcatatattgacatctccttttaacttcttcattatttagaaccaggtttttgtggtatttcagaaagttttttcttccataccaaaatatttcttgttgttcttccttcttttgctcttagttttaagctctcaggctcacagttctctatgatataaaatgcaaatgaagaatcgtggtatctttctcagtacagatatttttcttacggttggtttttagccttttgcaaaacttgtgttaagagttgcaaatattttaagtattatgttaattttgaccggctatatattttaaatgtattttctactttgctttctacttctgatgttctggtgacccaaagacctacctttacctgtaaatcaatctacagctttgcataattgattctgttggcaaaaataatctgattggctgattagaaataattttgtccacccttaaaactgctaatccagatcagaattaagttgtgttatttattttggttgtgcaggcctaacgtaaaagcaaaaggtttactctctaacagtgatcagcgttattaatttttgtaaactaagaatttctgtagaaatactaccctatgagaatcagaaactccagaagtttcgatggcactttctttatgttcaaatcatcaattaagctgttacagggttctactagtttatatggcatgtaaagtatatagcatggagaaggaattataaagaaattatatgaatgttatgcagtaatacatttttattttaatgtttaaaaggtaaattatttttattattataatttcagagtagcacctaacaccatatgttcttcactgtaattttccttgcatcatcttatcaattagctgtaaacatgcttattttaaaatgccattcaaacgcctctaatagaatcctgtggcaaagtgaagaatccttttacatacacagtacagatgtatcaaaaccatgtactgttttgtttacacacatgacagaaccaccacacctgagtggcccaactgagggttacagtttcagtcattctgttaggagtcctcctaccacttgcatatgtcagcagtgaaaaataatcaacaaaagcatctttgaaaagcaattttagatcattaaagatgtatgaattttgacaaggcgggagatttgaggctgattaagatttattaggtctccacattgaaggaggcatttatgtctcatttccaggggaaaggcatagcctaattgtagcctcatgaaacaagtggacaggggcaggtacaggtacagaaaaagattcagtcttagtcctgactgttcctacacaccttttgtgagaaaaagagccttttccagtaggtttctgaaaataaacaggatcttagaatagtccctgtttcctaatgggctatatatgcgataaatcattgtctatctggcttgcagtcaagagatactgggtaatcgttttctaaagaacttacatgtgccttttccaaatataacatcaaaatattacatttgctcaacagtctccatttctttttcttctttttgcttatttattaacttttaaagtttcattatttgtagatctcatagttgtaaatttccaaagttctttaagaataaagaattgattccatttgttctgctcagctattataaaggagaatgttgaaatgacgagagtggagtgcattccaaataatctgtgaaaagtagtgttagttcagtgagttgaaaatgctgagtatttgctggaatcatgactacatttgctaaaaatgtgaatagactggatttttaggagatacgaagtgcatctctgtcatgtgatgtgagtcttatgtcagctgaagctactcaatttgcatgtagattctgaaaattttcttgtcccatgtgacacttctgaaatgtctgtctgttcttttttcctttttaatttcccaagctcactatttggataagatagttaaaggtactgtatactcgctctttgttgacatatctacatatatatctctatataactgtatatcactaggtttgacaatagacttttccatgcatatttttgtaaattataaatcagagttaaattatgtaaaatgccttggatttaaagtattgagacttaagtgtctgtgtctcatttttataattttgggttatcacagatttcattctttgtaaaagcgttagttttctctagaaccagaaactgaagataatggtacatttgctgttttttggttttggaggtttttttctttcttttcttttttttaagatcttcactgttggcaattcagcttaatgagctttaaattctaagctaaagaatcacaaatactcttatcacagaataagaaattgtcaatctaaagaagatcctggttaacatgttgagagaaatttcgtttatttcatatggaagcttctttggtttttttcctaaatgtttcaaaatatatgtggtatcacaatttgtgttttgttattttttaaaacctataaatactgtacagtctattaaaaaaagaactgataaccttgttcagcagaaaacagcagattctcacatcttcagttatcgtagaaatagatggaaaaagttttttcagaagagaaaattccccttccctttctcctcagattacctactttctattccttgtttgtgcttttcattagaatatgaaaatattcatggcaatatccaggctttcatataccaactcctacgtgcagtcagtcagctgccgcacctccttgtcagtggggcaattcaacctttcgttttcattaaaaaaaaaaaaaaaaaaacacatccataaggaagattcaccttttatttattgaataatccataaatacagacggtaattgtctgagcgaaaagaagcagcaaaattaatctcttcctgacctgatggtatccataagtgtaatttcattgtactcttccatgagagacagtcgaaatagtcttctttctgttaactctaatcttaagagacagaatgtctcttggcgatattttcttttcaagttccacagtggaggaggggacaccaatatatgaataattcttctaacacagacttaaacatctttaaaaacagattgttccctgaaattttgtcaccggagcaatagtagcattcaaatgataagaagctgtaaaacaaaccccaattgctatagcaagtatttttattaatatgttttataccaaattataaatagctctgtccacagaaatctgatgaatagccagttattcttagaattttagagcatttctctccttgcttctgtcagtgtcatatcacactcataaacaaggacaccagaatctacccaagtgtcatcctcataaacagatcacattggctgcatgccagatatcatcagtaggaagtggcaaaaattgttttttttaaatgtcatgttagactgaaacaattatagattttggatatattaaattattttaattgtttcccaaattttccctccttgcccataaaagcagacaagataggatataaaggtaacagcataaaagccttagggagattgtcacaaaatatcactcttcgctatctgtcttgaagcacgtcactaccgtgtttttgttcagtctatcaatgttttattgtggtccttatggtatttcattttgtccgtcctaagtaatccaatatgcacagctattacatttagttggaaatcctgtcggtcctgtcccatccgtatgcagcctgaatcctaatgtttgttagaatagatgctaagctgcttcactatttcctgggctttgcttattctgtgacaaggaatgtactcttggcataaagtatagtcattaatcctggcctatactttgtgcaattatttaatgcactgtaatttcacatgaatgtacggcaactccgaggccagataaaattaatgttctctttttgacatcattcatatcctcatacccactttcatgcttttggagtttgagggaatttttttaagcaacaaggtgctttaagaaggcatgtcttgataaatgaccagtaatgtttaaaacagattacaaatctagactagggattctgaaattattttgttgagatggcttttccacaccgtacaatataccttgttgcttggctaaagggaaaaaatttaagttaattttgtctggcctgcagctatttagtggatcgttgcatatatttctgtcctgcacaggtaagtggtgtctcaagggtcaggccaatcaaagatgccacttggataagaattagattccatagataacgttgctgtttctatccatgtgcaattacagtatttgtgctgtttataaaggcctgttcccactaagtgtcccttatctgtttattttaggtgcaaaaactcaatactcaaatcactggtgttttccttctttgtctcgacagagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggaggtaagaaatactgagcatgaacacgagtctgtgccagagcacaggttcgtaagtgacagtgagtacatagatatctgttgccaaaaaaaaaaaaaaaaaaaaaaaacctgatccccatcgattagattgattgaaaaatgtatgagtgctgatagaatgattttgctctccatttttcctgaaacaaatgcaagattattatcattcagggaaaaggcaaggtaaccaagctactgcataatgtccattgttctccattccttttcctggtccccaggtgactcttctcctcaaccacagtatttagggctctgtgaattgggagctccaaagcagtattttaataactgacattccaaaagatgcaaagaattttccagcctcttctgttgaaaggcatggatggaaaaaaacaaaacagtaacagagaacagtcccctggatgctgtactctagtgacgttttatccttaacttgatactcggttaaaaagatggtgagattccacccagttgaagcccttggttaagaataattattttcaccgttgacctcagcctccatgtactgtattttaatttcagggaatagagtgagagttggtgatttcctctccagtgatggaatagttggccctgatagctgttttgttttgttttttgttttttgagatagagtttcgctcttgttgcccaggctggagtgcaatggcacgatctcagctcaccgcagcctccacctcccgggttcaagtgattctcctgcctcagcctcccgagtagctgggattacaggcatgtgccaccacacctggctaattttgtatttttaggagagacagggtttctccatgttggtcaggctggtcccaaactcccgacctcaggtgatccgcccacctcggcctccaaagtgctgggattacaggcgtgagccaccgcacccagccagctgttcagttttgacatagctttagcgctgcatttttaggagggctgtagttcctatccgggcctctgtggacacttgccacgtgtgttaggttgtgtttccctgccactccaccagccccaaccattctctctgctctttttgagactgtgcacatggatgataaagcactggctagagtgtaggttttggagcagacacatcttcactgaaccatgtagtaatcatgtgacctcagacaaaatctgtaatcactttaacctcaattgccgcatctataaaataggaataaaagagtttttgaaaggattaagtgagaagatgcatgtgaagtgtgtagcatattgccaggcacagagcctgctctaagtagcagctattattatccagtttcccttctttgctttcaaaagtgctcatcttgactaagtgaacttcatagaaggttgtcagagaagattgaatagcctttgcctttctatacctatagagggcctcaactactattctgtaggaaacagagcgaccagaaccaacccctcaacctcccttccaacccaaaacacacacactcacacacacacacagagacacacatacaagcaagcctgggccgacagtcattctcaaagcaaatgttacttgtgtcttatccttccgacaaggtgctgcaattctctcctttagtttctagcagactgttcactgttttctcttaacttggacagtcaagaaacttgagccacaaattctgagctaaagcctttccttcctgctccggatagatttaggtggcccgtagccttcacagcttttcctgcttaataataccttgttgcctctgactcctcttaactgtgtgctttatagacatggcagcattaatcctctcaaaaccacagtacagatggctcctctcttcgttactttcccccaaagaaccccctactccaatgttgctattgcctagggaggaaggagagcttctctttctccttgatcatatagttcagattttgcttctaagagaagattgcactgaggagtttacagagtctctcagagggaagcgggctgcaggaccaagtctgcagagacactgccgagtaatttaggggctaatcaactctttagtggtattatcagctaaagaggtttttccttttcctcaaaatttatcaactgtgaattggcctcattcccctttgtttattctgattagcatgaaactatgctatctctaggctcccctctcggaggggaaatctgagctgacagaagacctcctgtggattctctgcttatctcacataatttgtattcctgcctctaacctaattttgctgatcttttaagaaggaatctcagtgccagccttcttatgccctgagattgtaacctggatgctttataacctaagccagcgggttctttgaacttaagcataagctacatgtataaagatggtattttccacaccaaaccccaaatcaaaacacgaaagatggcaatgaaggatgtcaattatatgaagacagtcgaacagaatgtttaggaactataaatccactccttatttaggactagactggattttattagactgaaattctaggatatatggtgactgattgtagtgttatagatccattgtctaagtttagttatcaaaatggtgacttatccagagagtagctaagtaacttgatttagcatattaaggaactcaggaggaggagagggtgaagagcccaatgtggccctagtcagcaattgaacactcccaataaatagctactatagtttgagcaattttgtagaacacagtgtttgtaaaagaagagcaaaggaagttgcgtaccattcccggaactaaagaagtatcaaaaaattttaaaagagacatccatcatatagggagatcttgaaatatcttcttaggccaagcatcttccttcccctgcaaaatttattttacttcaccccgtcaagtttgccccatcaccactgttcaatggtaaagagtttaaacatctgaatctcactaaataggtgttcctccttgccttcatgtatgtctgtccccctttatctctaaaaagctgctttagaagggaattccttatgaggaataggaagaacgtagatgggggcgacttatcttcagccacccttttaacacctgtgctgctttccaataggtccttgtttcctttcagacaaacagctgtcatgtacgctgggtaactgtagcttttcagagctaagggcaatctgttacccgtaataagggccctgacaaaggtctccactctctatgaaatcagtaaggtatccccctcatctgcttctcaaatccagctccaggtaccaaatagaggctttgggagcagatccttttgacaaaggcaagcaatggattactagattcttaaatcacacagtggaaatcagaaacaatgctcactggaccagataattgtggataatatccccaatggggcacgtagacactttgggagcaactagttgctgtcctgtcctaattgagaaagcttttagagcaaatgatcaccagtacttcacatggcttataaatctttcttcttcaactccaactttacttatgaagacaacagtcctgtaaattgagcatttgttgctcatatcccaaaacactgtgatcatgaagttgctgagtccagagaataggaaggtgaagagatgggagctgctcactcctgaaggaagtgcgatctggagtgggggttaagacagtgactgttaaccacagtcttcggttcctcaagtacctcttttcaccagccatttgcattgaagtctgccctgtctcacagtgaaccctaccacagacttccactccccctcaacaggaaaaccttctcctttttgaaggttctacttgaccattctgaccaggaaagaccctggtctcacatgtgagacgttcaactcaaacattattacacgtaaaaaaaaaaattattagcttatataactgaaaaattcagatagagttgcacccaggtgttcaaatgatgacaccagaaacttaggtatattcatctgttaactctgctttcttctaccttagaatcattctcaggccatctcctccccaaaaaggccaccaccagctctgagtttacatttcacttcctaataactccaccacaaagaacacacacctttcttcatggttgtgtgtggcctgggcctgagcctgagcctcactctcgttggtctgaattaggtcacctgcccaaaggaaaactgaagtgctgtcaccagaagaaaggggcttggatgctgggcaggcagaaaaacggtctactatgggaataagaatagttctccacagcattcagctttagtacagtcagatcatgtactgcagtaactagttcatatgctcatggactgtcactttcagaaggaatcttcttctctctgtctcctccttccttgccaaagtatagccttttgacttgacaagaataccagtgctgaacctctgatgtgctttttagtgcccaagattagcaaggcagctatctaattctccccatatacttttaaaagcatcattgcttttatttagcctgctgcgaagactcattcggcaaggggttgcttgactttaaatagctctccaaatgatggtctcactatgcaagcaccaaaaggcaatagctcgccagagataattctgtctctatggaaacttaagatactttttaacaagatgatttctccacaatgcattgtccctggcagtcgttaccaagctcccatcttctccagagggagatctagtcagttccctttgacaccttgcgtccctgtctggtcctccagtggccagctcccccgtgggcacctgagacatgagactcaagccctgtcctggagactggctggttgagggcacaagaatgactttaaaagatacatactaaactttgtgcaagaatggtggaataccaaagcataactcctgccaagaataatacatattaccagtaaaatagagttcttttttttttctttttttttttttttttttttttttttgagacggagtctcgctctgtctcccaggctgcagtgcaatggcgtggtctcggctcactgcaacctccgcctgccgggttcaagggattctcctgcctcagcctcccgagtagctgggactataggcgcccaccaccacgccctgctaatttttgtatttttagtagagacggggttcaccatgttggccaggatggtctcgaactcctgaccttgtgatccgcccccctcggcctcccaaagtgctgggattacaggcatgaaccactgcgcctggcctagagctatcttttatcctttagaattattactttttggggggtatatcaggaagatgtacctaaaacaggccattttttcaagcctctaggggctgattacagttgagaagaaagcacaagtcaactgaggttattcagaaataagaaagatagaaataagaaataaataattagataaataagcaaaagaagcagaaatacaattcgaactgcaagaaagctgggtgcagtggctcatacctgtaatcctatcatttagggaggctgaggcagttggattacttgagcccaggagtttgatatcagcctggccagcgtagcaaggccccatctctacaaaaaatataaaaatcaggcaggcgtggtggcacacgcctgtagtccgagctactcaggaggctgaggtgggaggatcacctgagcctggggaggtcaaggctgcagtgagccatgatcgcgccactgcactccaggctggatgaaagagtgagaccctgtctctcacacacacacacacacaaacaaactgcaataaaaagtaggaatgtgctatcactagaaaaggggagtgaaggattgaaaacaaatggatgaaatattaatataaacatgagaatgagtataatgaatggagagatctatatttgtagattactcagtgaaaataaggaaatgtttgaaaatagaatttttaaaaatctagcaagaaggtgggactattatgttctctaaaaacagatttaaaaataaaaataatgaaatggcaggaaacagcactggaaaggaagcgggggagagggagtttaaaaaaaaaaattacaagagatcacaagtatttcccaaaatgaatccagatattatcagacatagagtggtgcttacagtctcagagcattaccctgtattattcaggtagatgatggtttggggggaaattactattaatttgaaagactctactggatcctacctaaagtaagaaggagattcaggttactctgaaccctttggctatccacagaattttagaggatagtgaatcccattctgggggaagaacatccagcttgtgccctataaagcagaggacttcagtagcttcctgctaggactcaaggaacgtaagatttaaccactgcatcttaatgggttttagaagaagaggaaaatcagagccacacgggttggtactaaaagtctcccctcttttttttttttttttttgagacagagtcttgctcttgttgcccaggctggagtgcaatagcatagtcttagctcactgcaacctctgcctcctgggttcaagcgattctcctgcctcagcctcccgagtagctggaattacaggcgcttgccaccaggcccgtctaatttttgtatttttagtagagacgagatttcaccacattggccaagctagcctcgaactcctgacctcaggtgatccacccacctcagcctgccaaagagctgggattacaggcgtgagccaccacgcccggcctaaaagtctcccctctcttttacacccgtgcccagcagctgccacctgaagcttaagaatgtggacgtgggcactgcgtggcatctctttagaaacaggcctccgggctacatgtctttccatgttaagaacccctgcattaaggtaaggggttttattagaagtcgtggtacagagatactacactctcattgtcagaagagttagccaccatcagtaacttcgtgggcatctcgtgaattcatatgcacatttatgttattaaacttaaataaatactattctaaatttgattcttccaaggacgatatcttagagatttttttcatgcccgtacacataggcccatctcattctttacaacagaaacctggtgtactaattaatttcaccactgctacactgacgataatttaattgtttctaatttttttgcccttagtatagagacaaatctgtagcgaatctgtgtgtgtgtgtgtgagtgtgtatctgcatatgaatctttgtgtaaatgtacaaatatttctttaggatggatttttagaggtgaacttgctggttcaaaaggtattttaatttttaattttgatagctactgctcaattgctttgcaacacttcatcaatctgaaggtgttcatagtctatctgtaattattgtaagtaaacaaaaatgttcaacaaaatgaaaaatatcaattttgtctgatgaaaatgaccccatttttatcattttaatttgcattttcctaattactagttagattgatgatctttatatttatttctttttttgctaattgcttatttatttcccttgtttttttctattgagctgcttgatactttctttttaactcttaggacttcattatatattctacttattctttgttaggtgtgttgcaaatattttatcccaggtgttcacttatcttttaactttgtaatttatggtgcatgcagaagctttcagttgatatgacataaatttgtctgaggtttatctttttagtcgtgacttctgggttacgtgtcttctaagtagagcctttctgagatgagacatagtgttacaggatttcatataatttcttctaatactttttataattccatggattgcttaatattcaattaatcaagaacatttttaagtacctattggagtaaaaaagaaataggaattcaaggattagcatagtgtctgagggtagggaaagcatgatagaaaaaaagcagggcatctctcatgtgcttctaagccttttcaactgtttagaactcacaatctttaggaacttaattcattttttccttcatttagcaaatgtattaaatgcctacttggcgccagcaagtgtgcaaggctctggggatacgatagtagggatggatagtgaactagatgagccctcaaggagcttaatgagacagttgtctgagatgattgctgaaggaattgagggctatgtggagaagtaagagagaagcttagagatctccgggcaaaggaaacgattgtggtgaaaggtcttataagccatgttaaggagttgtgactttactcagaaggcaatggagaccaagtaaaggaagcattttagccagagaagtgaaataatcagatttggtttctctaagggtactctggctaacatgtagagaatggatagttggggcaagactggaacctgggaaaacacactgttgttaagaatttgtcaagagaggaccatggtggcctgatggatagtttcagggaaagagaaagaaatagactaattcaagagagatttgagatgaagaaaagaagcaactggtgattgattaggtgccagaaaaaggaagagacgaggagtccaggataacgttcaggtttctatgagaagctgagcggggtggatggtggaaccattcattgaaataggaaattgagcagcagcgtatttggaggagaagatcatatacagacatgttaaatcatattacacatgttaagttttagatgcctgtgcaatatccaagccagatatctagaaggcaattggtggctttgtagttcaggagaatgaccagcctggagtcattagcattgaaatgatgtgaacatgaggtccaaagccaccaggagagcactgatgtagacaaccaagaatgtgtggaaacctagcatgatcccaatccagaaatgaatgcatatttcagtttgtttcatgcatattacagaatgtgactaaaaagaataacaaaagttacacctgtatacttttaaaattctgaattccacaaataaaatattacatgggaatttctaattcggacttgaaacttggaagttgaggggtgggggcgaagtaccaaatactgtggggaaggacagtgggtatcaattatcttttgagtaaaaaagaaaattcatgactttttgtccagtctgtaaaccaaggttttgaaaaacaaataacaatatccatagctctttgaaagaagaaagtgagagtattgacaagcagcataaagccagcatagaaggtaacccaggaaaagacctgtagtcaagagttttaataatccaacaaaatgtgtattgtttaaatttgccagaaaaaaaagaatcaagagtgatgtgtaaagtataataggaaatatgacaggatagagaccttgaagcaggaccagggattggcaaacagtggcctctgagccaaagcctgattttcttaatagttttattggaacacattcatgcccattcattgacatattgaaggcagagttgaacagtcgccatagagactatatggcccacaaacctgaacgtatttactctttggttctacaaaataatttcgccagccactgtaaaagaccagtgaaaatgcccaaagaaagataagagcatgtttaaaaataatggacagaaaagctaacgagagcaataatattacagactgagcggagggaagcataaacagtatgatctactttacatcagagtaccacgtagactgcaaagcctaaacagaagaaagacaggctcttaactgatcactgcagttattattcagcgggttttgagcatttctgatttatgtagatttttatgattaatgctattagacatggcttctataccaagataaatttaagccaacctaatattcctgaaactaaaatggaatctcgatgatttttgagaagctattccacaaagacaattttactacactatacatttgggcaagtgggtaatcaacttagttaatactacataaccttagctgccgtataaatacagaccaaaaaatgaaaaatgttttctcaagttataggaagccagattcataaccatccgtcacttgcttgggcaagttactgataaactctgcagaagaataacaaacagtgtgtccctgcaccttggctgttgaaaatgagatctttctctgattgatgttagcagagaggcttgtaaaaatgcatttccaactgattagttcagaaggtgtcaatctcatgcagttttatgacctgcagactacatgccagatgtacatttgctttttataaactaacaaagatgaatgactaaatttgagcattcctctttggcaactgtaccatctattgcctaagggaagacactggcagcattatggcgggggagaagagggtaaggagcacttaacccttaacttaccagattaatggagaaaaatataatatttggaaatacttttcctattgaatcatttctacttttgttgaagaatgactgcaagggaaaacctgcaagaatatcagatatttgtgttgttattctcccaagcatatgtacccattcgaaatccatcaagtaagaactaaaggtactatatcataaaacacatttgaaagattcgtcataaacatcaaacatataactatgaattgggatggaaaggttgaggttttaaaaaattttttggtttgtttgttgttttgggttttttttttttgaaacagggcctctccctgtcgcccaggctagagcacagtggtgggatcatctctcactgcaccctcgaactcctgggctcaagtgcctcccaagtagctgggacttcaggtgcacaccaccatacctggctaagttttctaactttttgtagagatagggtctcgctgtgttacccaggcctgtcttgaattactgggcttaagtgatcctcccaaagttctgggattacaggcatcagccactgtgcctggctaattgtttttttgaagccagaaatgatattggagcagtaggtcaacagtctactacttcagaattctgaatcttaacaactatgcttctatttctttgagagagagggagaaaaaatgttttacattattattatatatcctcatgaaaaataagccaatagcatagtatagtctttcttccactagaaatattgagaaatatttatacatttttcatcttcatgcccttttgcctaggaaagtaatattttgataaatttatatgaaatttccaaactcagtttcatttgattttcttttcttttttttctttttttttttttctttgagacggagtcttgctctgtcacccaggctggagtgcagtggcgcgatctcggctcactgcgacctccacctcctgggttcaagcaattctcctgcctcagcctcccaagtagctgagattacaggcacccaccaccacgcccctctaatttttttgtatttttagtagagacggggtttcaccatgttggccaggctggtctcgaactccttacctcaggtgatccacccgcctcggcctcccaaagtgctgggattacaggtgtgagctaccgcgcccggcttaattttcttaaaacatgattttagcttttttccagagaaataaacatgcagtttcaaatggttaacaactcattatcttagaaatataacagacatgaaaatacatgctatcataaggaaaccgtgtgtaatcagatctgcttatcagaaatcctgacccacacattttcatgtgtatggaaattatggtaacaaaaaacttaaaatattagtgtgaaaagagtccaactttataaacttaattcagatattcacttattaagcctttcccccctcccccaactacaaaggaaatagtgaagagatttttagttactgtctctggataagctaggtctctgtcaatttcaggtgacagaaaattgaattcaaacagacttaaggaaaaagggaatacgtttctataactgaaaagcccaggaggtcaagcgcagcttatgtctgtgtctgacctgttagtttttgctccagcccttgctccgcttgcctggggatggctccattcccagcagcttctataccggcagcaaggtggctgcagcaatcccagtcacacagcctcacagaacaagcctggtggaggggtaagaatctctttttagattgtttgtgaaattcgctcttgttagacatgttaggtcacctgtacatttctgaaccaaacaggaagggaaggttatgcacatggcctgagaggtggggaaggccggatacgcaaacgaaaagtttcatctgttgcccaaagaaagggaaagggtctggggaagcacagcgtccgctacttttattcttcagatggccaaaatgacctgctgagccaggccttctcacgtcttgtttcttaccttaccgtgttgttgctgacctgccttttagactgggcaatttaattcaactttgtctgttttcttttatctcagtttgctgtcagataatgaaggagcaagctaacattctattaataagaatagcctaacttaaatcaatggctagtatagtatttttttaaaaaaagactttattttaattgtataaataaaacataatggtcatctagatattttcagctgagcttgccatcacagtggtcagacccagacttgatacttaagttggaagattttaaaactattttgtcagttctcctaagagtgattaaagtcttcagaaactgatatttttattaatctataccaataaatgtaattaccaaggagataaaaattcatgttttcagctgggctgagtggctcacacctataatcccagcactttgagaggcctaggcgggtggatcacttgaggtctggagttcgagatgagcctggtcaacatggtgagaccccgtctctactaaaaatacaaaaattagccaggcatggtggcaggtgcctttagtcccagcttctcaggaggctgaggcaggagaatcacttgaaccagttaggcggaggttgcagtgagctgagatcgtgccactgcactccaacctgggtgacagaggaagactcagtctcaaaaaaaaagaaagaaaaattcatgtttttcaactggtcagtaaagcctgaccttaaaggataatgttatcaaatgatcataacctgaaacactcaaccactaatggatggttatagcttttaaacaggatacttgcatgggccattgagtgtagtttccttctgatgctcctggagaaagcactggcaaattcttctcatccattattccttttatgtcatcaatactataggtcaatttttcatgatggatttcttattatttctaatattatggctgatttacatttaccacattttaattaatacctccattttagtgagtgtattctaggagtccaggctcttgtttaaaatttgggaaatgcctgattttatctggaacacacttaaccttccttagaagaacttttttttttttttttgagacagttttgctctgttgcccaggctggagtgcagtggtacgatctcagctcactacaacctctgcctcccaggttcaagtgattctcctgcctcagcctcctgagtagctgggacaacaggcacctgtcaccccgcctggctaattttagagatggggtttcaccatgttggccaggctggtctcgaactcctgacctcaggtgatatgcccacctcagcctcccagagtgctgggattacaagcatgagccactgcaccggccagaagagctattttattgaaaggtggttggctcatctcatccattttatattgatttgtgtttgctacacttcataaactttcactttctgaccctctcccaaattttagagcttcgtcctacatagattcctatttatcatacacacttactgtgctaactcctagtgcattttctctaaaatatagaatatttgagtagctttacttacaactaatccatattccttcatactcctaccaatagattgttctaatcactaatttttttatttcttactcagaacaaacattatatgattcttttcagccatctctaatccaaatatttactctctatgaaggcagatgcaagtagatttatgtgtcacatactgatggggatatgttctgagatagttgctgttaggcaatttcatcatggtagagcatcatggcatgtacttacgcaaatctagatggcacagcctactgcactcctaggctacccatctgtacagcatgttactctactgaatactgaggcagttgtaacacagtggtatttgtgtatctaaacctagaaaaggtaccgtaaaaatacagcattattatctatgggaccactcttttatatatggtctgtcattatgtggcatgtgactattgtatttctatttcttctggtttcaaaaagtatgcctcatagaaattactatcagatagtcgggagaaatcacttgatgtgaaaaaaaaaaaaacagtcaagaaacaaaactgattctacattatggcatcaaaaggaaaattctcttactggggaacatttctctctacagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagaggttaatgcttcttttccatatgtagatttgtaatgatgttatcaacagttacatacacttatgtgaaatactcatgactgtgaacctgaggaaagtgctgttttttaaatacagtttttcctctttctgcagattcttcaccaaactttgtatttcaagcatttttgacacagttcacatactttgtcaatttcagtacctgagacataacaggacattatattaaagagtcaataaatcttcatttaactagttgattttgttagcacagttggaaatgtttcaaaagaagcagtgaaaagaccccaaaaggcagaacagaagtgcacttttttttttttagctgagctcactaaataatataaattatgaatgaatgtaatggaactgctgacggcatggcagtaagattgcataagctgtttgactggtgctttgcagagcagtaatgacctgaaagtaaagcagtaagtgaaagcaggtgtcttgtgtctcactgagcaaaagaagatgatttacaccagaactcctgggtctgcagtaatttaacagcattaatgcagttatagccagcagttgattcaaagttgctgtacaaatgttccttatcgcccccttaaatcttatacttcttggtccctgaagatttactgattgcctcagaattaattggaaagtctacttttcttcatgtgagcaccatatatatgacttatgaaaaaagcacagagtttatcattttaaaaattcatctctaaattattagtcttgataacgctccaaaaaacagattgccacaaattaaaacccaggataaacacaagccctttagagaatatgcgttacactgaattaaaagggacattgtcttgggagtatttcaggtctgatttttgtgaataacgatggattgcatagcatagtgttattttatccttaggttgaattatctataaatcatgataatgttggcctgaaaagacagatgttcattctcattcttctgcttttccaacagccttgcatctgtcatcagaggccaagtactgactgctgatggaactccacttattggagtaaatgtctcgtttttccattacccagaatatggatatactattacccgccaggacggaatgtgagttagtcccatcacactatctctgaaggatttgaaatataaaaactagaccttcctgtaccactgtcatgtttgactgtccttttaaatatggaaatgcagcaactttttagactctacaaacttgtgacagtacatatggcagagatttaaagtcatatactcacatacttcttcaaaagttgattttattttctaaggcatggtaatactgtagttttgtaggagaatgctctttgtctcagcagatgtatgttgaaatctttaggggtaatattttataatgtctgtaacttgagctcagatggttccgagaaaagagtcaatggaaagcaaatttggaaaaaaaaattggtgaacttggtgaatacacataggacacaagagtatttattgtataactcttggaatattcccatagatctgaaaatatttcatataaaagttgggagaaaaagttgattttctttataaagcatattaacttaaggaggtgtgtattggtagttatgtgggatccagacaattcactaagcataccttgttctttcttaggtttgacttggtggcaaatggtggggcctctctaactttggtatttgaacgatccccattcctcactcagtatcatactgtgtggattccatggaatgtcttttatgtgatggataccctagtcatgaagaaagaagagaatgatattcccagctgtgatctgagtggattcgtgaggccaaatcccatcattgtgtcatcacctttatccacctttttcagatcttctcctgaagacagtcccatcattcccgaaacacaggtaaaatattctcacaggcagtacttgtaaatacaagatcttcagatcatgttttgccagagaatcttaaaaataggttatagagtccgggcacggtggctcactcctgtaatcccagcgctttgggaggccgaggtgggcagatcatgaggtcaggagttcaagaccagcctggccaacatagtgaaaccccatctgtactaaaaatacaaaaaaaaattagccgggcatggtgatgggcacctgtagtcccagctacttgggaggctgaggcaggagaatcgcttgaacccaggaggcagaggttgcagtgagccgagatcacacactactgcactccagcctgggtgacacagtgagaccctgtctcaaaaaaagacaaaaacaaaaccaaaaaaacccacggattatagaattccagtgctatctttaaataattctataagaccctgtctcaaaaaaagacaaaaacaaaaccaaaaaaaaccacggattatagaattccagtgctatctttaaataattctatagaatgaatatatagtgggtgttggggtgtgtgtgtgtgtgtgtgtgtgtgtgtgtgtgtgtgtgtgtgtcctacagtagacattgttatagtaggatatctagttatttcttttttctttttttttttttgagacggagtctcgctctgtcgcccaggctggagtgcagtggcacgatctcggctcactgcaagctccacctcccgggttcacgccattctcccgcctcagactcctgagtagctgagactacaggcgactgccaccaagccaagctaattttttgtatttttagtagaggcagggtttcatcatgttggccaggatggtctccatctcctgacctcgtgatccgcccaccttgacctcccaaagtgctgggattacaggtgtgagccaccgcacccggcctttctagttatttcttaaagatctactcaaacaaaatactttttcttcaggatataccttatatatttattaataatagtcaaatgaaactgtagcttaaactcaatcactaataatgtctttgttcatttatttatttattgaaaaaaaactttagtgcctaaatgtacctgacagcttgactgacattgtaccaagtgctactgacaccactcactattgcacatggctattagcctcaataacttactgtttaattattgttgtcagtaaaaagtgttttggaaaaggtagttttgacagaaaatattcattaatataactttttaagaaatagccatgcattccccattcgtttcatctactgaaatagctgaggattgtgttccgtcccacatgtttccagttagaaataactttcagatcttaaaagtaggatgttaggtgtaataataatggattttgccaggcggcgtggctcactactataattccagcactttgggaggccaaggcaggaggatggatcgagcccaggaatttgagaccaacctgagcaacatgacaaaaccctgtctctacaaaatatacaaaaaattagccaggcgtggtggcatgcacctgtagtcctagctactcaggatgcagaggtgggaggatcacttcagcccagagaggtcaaggctgcatgagccatgagtgccactgcactccagcctgggtgctgggagtgagaccctgtctcaaaaatatatatataatcataatagactgtattcgtaaagaggtaaggaaaaatctgtggtcattaaagtacactagcacatagcagctttgtcatattcattctcccgatatttcttgaaaacccgttctgtagcaggcgctgttatgtgagaacaaagcagtaaaccactcagatgaagtacctgctctaactgagcttcccaactcatgagtggagagaggcagtcaacaagaaatatgtcaggttgcgatgagacttatcaaaaaataataaagcaggggacagtggatagaggtatgatcttacatagtatagtttgagaaaatctcttcaataaggtgacatttcagcacaaactttaagaaagtaaaagaataagccctgaaaatagaaggggattcttggcttgttcaaggagtggcaaaaaggacagcaggcacagctggagtgaaggcggcagtgaataaatcacaagccattggagaccatggcaaagataactctttgagaattggaagccattgaaggtgtttaagcagagcaatgacagtcactgatttcctcctttaaggaatttctatgctgagaatatcctatattgggcaagggtggaaacaaggaggccagttaggaggcaacctcagttgtccacaggagaaattatggtggcttggacaaaagtctttggaggtagaagcagacatggaagagtggagtccagggaagaggttgaaactaaagaggtaaatttgggagtcattcgcatataaatataaagcataaacctagggagggagcacagatagagactacaagaggtgagccagaaaggtctaggataacaaaaagtcaaaaaggctgacaggcaaagatgttgcaatagcaacacctcagggattcattgtaaaatggtcaagccaactttgagctgaaacttttaagaagttcattgtaacctcaatcaatttaatacttcctccccaggcccatcttgcaggaactctaaacttcgtagtcagtcctaaaatagactttacctagagtcagtatctgtctgtaggtgccaaatttctagcaaactaggacattaaaatgggtttcagatagtcaacaattccatgaatacatggagtcttttctccattcgttcattcattcattcatgcggtaggcaaatatttcataaaaatttactgagagcctactatgtacaaggtactttactaagataaaaagaagaagacgtgcatcctgccattctaaatgcgataaagattttaatgaagaatgatacaagttcaaaggagaggtcaattcctaagtaagccaaagaaggaatcactgaggagtttgggctgaaacaaggattaggctggagagggaggaaagcacgtttcagattgaagatgtgtaagcaacagtggagtggcaaaaacaagtcatgttgtagaggggacaatggggaaggaggcagaagatgaccccagggccagctgatgaatggccctgagaagcaatctagtggagaccttgaattccttaggtgatgcggaaccaagaccccagtggagttttttcagcatttctctaaagttaactcaagtggcaaaacgcacttgaaagaagcgcagaagatattgatagaaaagagaaatgagtgaacaggctgttcttgtgaagtgtatatccatgcgtatccagggctcagatggagagggcctcgcaatcacaatggtagtggaaatgaagaagagggaacacattagacagggattggaagatagaattggcaggacatggttcctaaccgaatgtttaacgggatcaggaataggatttaaagctcacgcagctggcaagagtaggcctgatggtttattttcccactttggctggatttacctttcctactaatgcaaaataacatggtcaagttaaattacatcagagaaacacatgctttaatgaacaaaattacagatattaaaatcaagtacaacacatgatattttgaaatagagaggcagcttctggaaggtcacaggaaatacatataatattcgtaagagagtcccttactcatggaaaacctgtcaaatgtatcggaaattattttgaaaataagaggaagcaaatgatgggctttagggttaaatcacatgttatcagggtcattctggagtcacagaatctatttttcaaattaactccttgatatttcactgattatgggagaacaatgagttatctttaaaccattcaccctaacaacctacagtcttacaaaagtaccctcaatcttaaatttaatggtttccctgggtctaaaaagtttctatatgtttgtaaactattttgcttaagaccgttttgtggctgaattcagtcagcatgtttgaaggaaaactccaatggtaataaattcgtgtatctacattagaaatgcctcttactgtactgtactgtaccacatcgcgtccctcttcatgccaacactgactgacaggccagaatggaagcttccttcgtccattcattcatgctgcttccaactgtgtgattgtttatattgaagctgacagctccaccctcagtacaaggggtcttggagggttttactgaagttattaaagtttggaggtggcagatagacatcatctttaactgttctatgtggaggtggtggggaaaggggaaacattgctgaacactgaatcactattctaagatctttccaacatgaaaaggcagccctttctgtctgaatagtgaatcttgatagggcaatataaggaagcctttgagagtactgtttaattcttcgtggagaaagtagtgagttcctggtgcacgttcttgaacacagatagccttgcacttacagcctatgtagaaagcctatgaagagctgttcttattcaccaaactaacaggagcattggtaaagagaatctgaactctttagaaaaattgtgtatgctgcctaaaatacatttttcaaaataagtaatgttttggcataatgtattttgcatttcttaatataaatattgtcagcatacactgactggtaatctatggggttaagagtataattttttttaatttgtaaaggagataattcttatgcacataattatattcatttttacagtccagtttcaaataaaaaagtgtgaattgatatgttctatgtgcatttaataacatattagttgctctctaggataaattgtatggagctttaaaatattagctaatttaccatcatatcaaaaatccatggtaagttggagctcaatctttaattatgacaatgtgctattattacattacctctcaacatggatatggaatctgctacaatctaacccaaacgattgggtgttttttgttatccttactgtctttataggctgtgaccagccagctgatgaggctataggtactggtttagtccctaaatgagccagctggcacaggccagatctttggcctagactgcatccctgttctgagctaaccatcttacaaatgtctgctctaattctccagggtgatggggtgaaagatgggttagtgagaatccactgtgactactgcactaacaagtcagtgcatgtcagcctgatggagcagtcacagtgtttcccgtatgaagagtagcacccgaggtatgattaactcagaataaatgacaggaggcttttaggaagagacatttgggctggcagcagagttatttttaattattgaataagataacagctcaaatgcatatttgtgaatagtgattcttttgtgttttattttagttgctctaaagcagctaaaataagcacattgtctttgtgagtaagtaaactaagacacagagagtcactattcacaaatatagtgaatatgtgctacataaatatattttatctaatcgtcatacgtgatcacagtttgaaacttctgctttattcaaacttaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttggtaagttccatataaatctttgctgcagtgaagtttttctcaaagccagaactatcataaattaattgtaacccagggaagtcagtggataaacagaatataaagagaataaggttgtcctagggatattataccttggctggtttagatctaccgtgggaaaaggaatgtactccatgtggcaagaagaagaaaatatcagccttttctggctgaaattatgttgtagaggaattctgtgaatgaggtttcagcttgtcacatcctttctccccccatgtttctttccttattttgtccctttctttttccattttcttcttctctttataactttacctccctggatttccttatttgtttttgttttctgtgtctaacactaatgtagtttcagtgcatactgatgtttaacaggatagcagacatttgtgtccatgaattacatcagctgttttcactagaacggccggttcattcaatgaaaggataatcaaaccagttgttttattgaatgactgaacagtgcaatcaaagtgtgacatgttgagagacagacagagagaaagagaataggtatatagtatagcttcaagctcaagctcagaacataaaaaactaaagaatgatatgtttttgttttaattagtatttaccttaaaatagaacattgtactctgaaattaataggtaatttggatttgaattagttcaaatcaatccagtaattgccacttctcctttcattttttctcaattttaaattccctgtttcattgtgaactctggaaagcttttcatctgtggtttattcatattactgctagtttgtttatttctgataataatatgtcagcataatgtcataatctggctagcttttttgttccattgaaccttacttatcataaatattttccataatttaacactcttgagtgaaaactaaagagttctaattattcagatggcaaacgttatttttagttgttatctaatcactgtttgagactgactgatctaattacttaaccggctgcccaatctggactttattttgtgctgtgaacccctcatgaaggggtggtatggggaaaaaaacactcattttctattaaatcagtggaaaataatatttggagatctttttttaaaaaaaaatctttggtgaaatcttcttaaattaaaaaataaactgctcataaataagtggaaatacagtctcagaacacagatgtgaaaaaggcagttttttccaagtaagaaaataaattgcatttcccccagtcgttggaaagatgagctgtgatttgtttggattccagtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtaagctcttgttcatagataactgatgttgtaatgtattgttcagagatagctaatgttgcccactttccaactcatgagattgtagcaacattttatgctatccatgctgtaggattagaaatggcagaaaaaaaataaaggtgaatttttaaagattataaaagcctaaagtgggaactgtataatactttcttaatatactttaaaatgttcatgaattgatcgccaaaatgattttcccattagaatgtgaaagactgactttggtgttgtaatggaagatctctgagtgggagtcgtcagcacagattcacctagagtgtctcattctacagtgagtcagtgagtgtgagccaaagtactttagaaaggtttaccaaaaatggagggaggggggatttgttttttaaaataaagaaaaaaaaatcatgtgacttcaccaaaatatttttagtagattttaattctcgggtaattattctgagtatctagatttttttttttcagttcttctcagactattagggaaataaagcattctgccactcaaatggggtcacatatattgttacttgacttggtgaatattaggggaaaaaatgaataatctgagaaaaaagcaagaatcaaaagcgttcctaggagtagacctgataatgtcctagtgaatatgctctgaagaaacatgtttcaaatgccgcagaccaaaagaggagtatttgcaaaatatgaccagcttaatctcatcaagaatattatttatatgaaacacaattctgttgtctagactgtgtttccaacattttgcccacatgctagctgcatctcagacaacctgaagggtgctttgctggaaaagcaggaccgtaagttaatctattatactttagcatcctgtcctacaccatatcatactagtactctacttttactgatagccagagaaaaaagtcacagtctcagcaaaataatctaactcttgactttgcagaggtttttggaaggttcagaatattgacttgaccatgtactacaattaaatgtttatagctaatggtcagtttttcatattaatgttgcttcagtgttcattcctgcttgaaacaatttttttgtgtgtgagtgtcagagagggtgcattttaaccttccaaatatatacagaataaagtagttttaagaccattacttgaaaatgctcgtgctgggcctgatgcagtggcttatgcctgtaatctcagcacttcaggaggccaaggcaggtggatcacttgacgtcaggagtttgagaccagcctggccaacatgataaaaccctgtctctacaaaatacacaaaaattagccatgtgtggtgatacgcacctgtagtcccagcaactcgggaggctgaggtgggagaatctctggaacccaggaggcagaggttccagtgagctaagatcgtgccactgcactccagcctgagtgacagagtgagactccgtctcaaaaaacaaaaaaggaagaaaatgctagtgccttccctccaggaaataatagtctgagaaaaccagtagtaaggaaaaacaaacaaaaaagcagaaaaacccttccctgcttcactattttatagcagtatattaagctctacaccccttccagttacgtcctggacatcaggatgcagttcagtttgcaccccgaattaaacagagcggataactagtgccacatgcagcacacattgaaaaggtgggactcctgactaagcaggggactccagtgttctctcagagcctctcttaactcatcagtggtgtctgaagcagtagtagtttcattctgttatattagtagcacaaggttcaatcatggtcttttaaaatgcgaagccatatggcaaacatgctagtagctgctcttgatgaaattgtgtaaaattatatttcacacagtttgaacatatttctgtattccttcagaaaccctctaaaaacaaaactaggggaaacgtctctagatgccatttagttatgatgagagtatagggtaaagttcataaccagttagctacaggatttcactcaagagattacgaatcaataggaaaactacaggcatctctgtagctccgaaaaagcccatgcctctgtaattcaccattgtatgatacaacacacgatattatattcaggaggattcagaaatatgtagatgttctgtatatgtataatataaatacacacatattctaaaccagaataacatatgggtaacttctattaaaataccagggcagatgtaaaaaccgaactttccaaaatgctgtcctcaaaaaaaaatgttctaaattataaaatatatttaggccgagcacggtggctcacacctgtaatcccagcactttgggaggctgaggtgggcagatcatttgagatcaggagttccagaccagcctggcaacatggtggaaccccgtgtctactaaaaatacaaaaattagccaggcttagtagtgggcacctgtaatcccagctactcaggaggctggggcaggagaatcacttgagccagggagacggaggttgcagtgagccaagattgtgccactgcactccagcctgggtgacagagcaagactccatctcaaaaataaataaataaaagaaaatatgtgttatttttaaatgtgagataacctcagccacagggtgaacagattgcagtttagaattttatccaagaacattttgacaagtagtggctttccaaagtgacatgtgtctaattgaataaacaaagtgatttgtagtcatgacaaggtggatgagctatagaaagacatgaaggaagaagagaatacggaaacgtagatgctgacagttattcgtgcgggcgccctgaaacatggaaataaatattctcatgttcatctttctgttctgtcatcatagagaagaagcaggaagggccaatcgttcaaagtaatgactgaataaatcagatgttgtagagcggtagtctgacttgtaggattcttctgatgaaaattacacaactggctcttataggaaattatagctccataattatcaactaacgtaatcacagaaagaagaatcttagatatcactaatgcattctttgaatattcaaggcaaaatgcatttcacctcttgttatgatccagccttatttagcttatttttcttaaatttgaataaacctgttttattttccctgatttctttatgtaaatttgctatgattattacatcacccaaatagcaaagcattaaagaagtaatcacagaatgcacctaaaatgtgctgagttataaggagaacataattattctaatttcttcttcactttaaaattatcccgaagtggggggaaaaagcactttctcaagtttcctgattgtactttcgtgggattattctttcaacagtgtatctgctaagaagtagggccattatctctgagaacttctttggaacatagaacattcaataaatagaatatatgccgctctaaagtcaaagcagcaggtggtgtatacagatgataacacattgagaagtgtcataaactgtgcatggaacaatagcagctgactaccccgtgtgcatcacgccaaactggaggcactgatctgtatagagcaatggcaaaagcaataaaattacaatctcaactcaaatctaatttctaaccatgaaaatatttaatattcatttggaagcttttctcagattttcactgaagaccataaaagagcagactggcattttgtcttgataaaattattggcacttccatgccttaaagcagaattcactgtaaataatacattggccttctacaacagttttgttatgttcgacattttgaataaccgcatgtatatgcattctcctattggatgagagtgtacgcaggaatagtctttgacaggataggtagagttaaaataagcctgtattatcgttacagctttggagtttgatgtctattttctacctttgttttccacaaagtttgttaactttaaagaaaattataaattcaaaagaaatttgtattcctggttcacatttttattgactgaatattttcaatattgattaacaatgaggcaaacttgttattccctaaagaacattatgtagagcctgttctcaaacctggttgcacgttaagatcatctggagagtttttctaaatttcagggctaaggctgcacctcagacaaattaaaccaccatctctctgggtgagaaccaagcattaatattttttggcaactccccaggccattccagtgtatagccatgactgatcatcactgatgttgagaattggggttttaattcttctcaggcttttgttcctttcaccagacatgatttcagttcacagtagacagcactgttggtatatatcctatggactttatcgtgtaatattttacactaggtagttgaatacaattcattccaatggagcttcaaataagaatgtcttaatccagacctgacaggcattgaattatagttaaaacaatcatgaacatgtttgcttttcatctttacactttttcatcataagaaaaacaatgcactttatttcttctaggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaaggtacgtctttcctaaatttgggcttttaaccaaagctaaacgtgcctctttaaaaaaaaggttgagtctgatgtactgatttattcatagaaaaataccatcctaaggtttaaaatttcccccagaaagaagtcaaattcttgcttaaagttaagagaagcataacacatataaattgtcccataagtgtattaaagagcataaagtcacccaatatatcaaatatcttactgatttcagtgaattttctgtgctctaaaaggctagagctatgattcttaaatctctttcgctttctttagaataaccctgtgacataggtgtagctcttttatttcatagtggttgaaattaaggcataaaatattttcctgtgatttcaggacctgatattaaatggactaaggctacaacttttaactagaatattggatcttcaggttgggttaatccattagccataatgccaatagtaaaagtaacatattgtctttgctttgttcatttaagtgtgactttcaaatcattctattctgtaagttatttggtaagccctagactacagaattcatttccagtatcatttctgccaagttggcaattttccatacaaataattaaaatctcagaattcaactcattatattttagaaggcttttctaactgtgctttctttttttttttttttttttttttacctttttttatctgcttccaccaagaaataaagattttagacataggtaagcatcttaccttaaggttattgtatattttcaaatatcctttttacatttcaatgtgaccctctgaaattgttttctaagaatatttcatcatgagagaggaaactcagtatcacacatcatcgaaggaattaaaagtgcttaattgaacaattattatacaatatattgcgagttatttacgtgatataatttgagaaatctttctcagttggttcataaaataaatttcattacaaaaaagtataaggaatatctctctataacaaaattatttccaagcattagttactgaccgacacaatctaagccatgttgaacagcatgaaacctgaagcacagtaaggaggtttgagaaggcctgcctggttccaagaaaacccctgacaggttgggttttattggagactgtttaagaaaaagaatctagaaatattttaccttggcaaattttttaaaacatacgattatgtgaacatgtggcttggcagagtgagaggccccaaaactgaagcttaattattagcttcccgtaaattcctctttgcctatagtttatattttcctaagttgggagaattactagatttaagaagtaatgttttcattgccattattatggaggaaatgactttcttcaaagtgaaggacgaatatagttgaagcaaatatatagactcagaagtgtttcatgtctgctttctgtgtacacgtagctgcagaagatacaataaagacttgtatggacacatttgattgaaaaactttgctcgggatagaaaaaaaaaggcggaggaaaccaatgttttaaagtaaagctggcaaaaagctagacaggttagacatgctagatctagtttggtcattaaaatatctaatgaaatgatatcagatagaaatattaataatattttatgtgaggtcttttagatgaataagtcaacataacccatttaaactgttgtgtagtgattagcaaacaaaaaccaaactagcaaacaaaaaccaaagttctactgaaagatggatagctgtcgcatatcagggtgaccaaacctggccccatgatcttttcctgagatcccctattgatcttaaacttgcagctaatagctcagtcacatgctaaaatcaacacttcatctccccaggatactgagcgtgcaaagctctgctattagaaaccacaatagaatttcaaaaacttgctggtcttgttttcttggtagctgtggagaaaagaggaaagacagacaggttgcacaccaagtaaatgtgaaaatgctggaggcaatacagaaaaaactatcaaagcagctaccttttaacaagcgggcctattccatgccgggcatggtgccagatattttatatctgttattgcagatccacacagcaacccctcagggttataagtgacgtagtagaggctccaggagattatgtatcttccccaaaatacatatctaagaaatgggtagcagacagttaaaccactctaaaaatatgttctttccacggcaccacacagccggtttttctgtgtcccagtggccaagattctaggggctcattccctgggtatgcaaaaagcaagacttatttcacaatcattttacctgttatttaaagccataatctctccctctggaaaaaaaaaaatctatgaggttagagttacgtctttattaacagtagaaattcattttgtactaactcctggtgtttggcagtgatactattgtaatccctctctcatgatcctccataatccttctcctctgtccatcatcctaactacatttgtgcttctgcatttcctttatgtgccatgcatgaagagtacactttttgggttttatatggatatttaattacatgaaatcaatcagcgttaactgatcacttaccgtgtgttaggcactttgaaaaataataatataagacaaaatacctcctctcagaactcacaatctagcagaggagacaaggtatatatgtgacaccttaaataacattatcagtatcattctttgacacttaatcatacccgtggtccgtggtttcaaatgtgagaatagttctgtaaaggaagagattactgggagatggcactacggtaaggaaacgttttctggaagggctgatatttgagctaggtctaaaaatgaagtctgcttaaatagaacagcaagaagaaaagagggcagtcatgaagaaatagagaaagcaagtaaagttactggagactgggggagagctgagcaagacatgttctgagagtaatcagacccacctgaatggaacagggggttcatggtggtaatcacgagagatacaggcagaaaggcaggggagggtcagattgcttggggccttgagggctctaaggaattattctctcctataggatacctgagacagtggggacccattttaggatcctgaacaagtggcacactcaaagtggccttttaggaagagtaatttggtgtcagagttcaaaatgattgaacatcagatcaattagaaagctgttgcagcttgagatgctagatacctaaaacaggatggttagcagtgaagaaagccaaacgataaaataaacggaaggagagaatggagagtatttgtctaagtgataagaaagaggaagatgtagagaatgtgtaaggtctttgagcccaaatcatcaaacatgatcatgtcattgataaaatagggattccatttgcttagtaagtaataaaattgacctagcaaagtcaacatattttagttcattggaacttcttcttttagcttaaaaaattaaagttcttttcagatgcttcttcctgtgtacctgcctatcgttaccttccctttcctggttaataagatccttcctggcgtgctccttatcctcgctttcttgggcagcatgagtcatgagaggcttaggaacaggtcataggaagaaaaagaaatggaaaagtgtgtctaaatctacaaaaggaatggtattgccagttgttaatgattaaaatataaaaatgcaaactttttatcctcttctatatttcatatactgtaaacagtctcgttagttggactaatgggggaataataaaaatattgaataaaaattagtataaaaacacattgtcttattttaaaattcagagagtgttctgttatatcaaactaataagcaccaccaggatattacctgaaataaaaattcttagctatactttagtgaataggtataaatgttactgatcaacatattaaactttttacatacatagaagctgctacaattctttaaaaatgtctttcttttagatgtaccaaacatttccttctctgatgtttatagtattagtttgctaaggaacccctttaatatgtagtaagttttacctcatccttgttccaattctcacacattgcaaaatttaaaaattacattaattaactaataccagccaaagggcacttaaacatgtagaactaaaaatcaactttgtgaattttatattaccaattaaaggatcaaagaaagtgtcaatcataagtctgtgaatttgaatccattaaagtgtagataccaaattataaaaattttattcagtaccccttattgacttaatatttaaaaatcaagcaggcatggaaatatcacaccccaagtccctgcttgcaatattctaaacagtcttttggttaccataaaagaagctgttttacttttatatgtgaatatagtttgttatgcttcttcaaatgtcttgtgttctaaaggctgtgacacagtttccaactcagaagatagaagtgctaataatatctgttctctggcttgttctttgtgaatatttctctagtctaagaaggttgaattatgacaaaataaatgagcaaatccagcctgcacttaccactggatctgtgtctaattgaatgagactagagaagatgtcttgataattgtgatgatctaggcaattcaggatgagttaagaatcaaggtgtaatatactaaaggttcttaacttgatctcagtttccttggttttgctattagtcaaaattgtaatatttcaaacctttctgaaatagtgaaatctcaaccaatcacatgagaatgctgctgtgcttccgctcagcagagatttcccaaaaccaagcattttgaaaatccctgtgctccagctgctggctgcagccggttccgtcgtggtagcctcacgttttcacagtagatagattactgacctaaaaattcaccactcgttgtacccacacacccgcctcttcagtgctttggcttttcagaaagttggaaagcaagcacgagctcacactgtcaactctctatgctcaaattaggtgaccttgaatcccagtcctatggcatatgattcagagcttcactgccaccagtctgtcaactagaaatatccagactcactttttttccttttagtacttccatgctgatccctcttttcatttaggagagaccagcatctaacaaccagctctaatttgccatcctagcctgcgctgctgggaatttgtcaagttctcatttcctaccatcctgtgggaatatttccagaggctaattctcttctctagggccacgtagactcccccacatttgttcttctggacaatagagttgtgtccaaaagtacagctttcatttatcagacatttttaaagccattgacatttgttgcttgatggagaaatttctatgtcttctaggaaggagatgcttcaggacaggaaataagcaaatataagcaccactttgggcattctctctttacttccccactaggataaaactgatgacaataaaggcaaagcttatcacttgaatgtccattcgtttttgcaccaagaaaactcacgtcccatagctaaagaggatgccaccaccactgaagctgccacctcaataatctgtttgtttgttttttctcaaaatgagggcatcctgaggaagtgtgcatgattcatttaccatgaatgaatcatcattgttcatcattactctctaaacaatttaaagtgggtatattgagtcttcattattttaatagtttaggatattataaactgctgttataacagcagaagtaaaaaaacaaatttaaacctaaccaagtttaggtttaacaaacctaaacctaaaccaagtttaaacctaatcagtttttttcttttaatattttcagaaacaactcatactttagttaattattgtattcctgcactttctaaggttataaggcaaaagacattgcactgtaggaagagacaggacaaaagcgagtataaggacggttaattcttagtgagtatgtagtatgcgctaggccctgttctaaggatcttacatatatagttcgtgtaatcctcccagcatcctgtgaaatatgtattattatcaccacctttacaggtaaggaacctgaggcacagataagttaggcagcatgcccagatcatacatttagtgttagtaatgaagttaggacttaaacccaggcaatcgggtacagagttcatactcaaaagatgtacaactgagaagaaaaaaaagtatgtgtgttatgtatacacatgagtgtatgcataccatgtacacagctagtcacagttaactgtataatcagggaggtaggaaagactagaggggcctctccaatgtcatgtctttcaaagtagactcagcttggtggagttgcaactctgtcaccaattatatatacctgaaagaccagctgtgtcaacattagactgtttatagaaaggaaaaaaaaaaaacctctaaaattgctctgaatgttatattgatttgtaactcttcacttcttacaaagtaataagctgccacattaagggatgcaatatgtgttgctgcattaagattgtaggcatcagcttaggaaaatgatatcataacacttagcacagcaagttgatcacttggcataacccagttgttctgaaatgtttttcttgcacaatgacttgcatctttctgagttcatcttactttttaccatttcacacacatttacacactctaagatgtcttgccctagtctgtcttttgtcactcaaaggctggaaaggagatcccaaagctgaaggacatacaaagctcaagcctttgtatgtctttgtatttctctgtatactaacatcacagcctaagagctcttcagagctccacaaggcctctacagactccatgtgtgatctgctggcctcctctaacaacatgagaaacacttaaacaattttaagaatagaatctcttacaggaatgataaagtacagctattcagcacttagacggaaaatcatcaagtagtgaaaattgttttattagaacctaacctcattggtaatgaggagactactgcatcactattagaataaaaatattcatataggtagatttattataaatattttagatgttcacaaataaaataaatggaaacaagcatgtaactgtgtgtgtgtgtgtgttcgtggctgtatgtggaaagagggagaggaagagagggaatgagaattaattaatataactaagttcgtcatcaaaagatacatggagtttgatagattcccatcatgttgacgtcttggttgggacaccaaatcatttaaattatttttcaggtttttgttcagaagacaatctttgcacatgtacaagattacattaattttaagaatgtggcattgagtgtctgtaaggatattaactttttaattccaatgatacgtcataatttgtcccctccttaacagtgttgggcttaccattttttacaagtaatgggacataaaatgttttacatttgcatttctttatatttataaaactgaggcactacattttgtatgtcactacattcatagacaggtttcagagcagctcagtatacaaactttggaaagaaaactgaaggatccagcatcctagctcactgccacaggccaccaactaagactcccccgtagacttgaatgacctcattttaatatttaaccccataggacagacactggcacttttctggattatgatagagcaaccaagacagatacagtggtacatttcttcagggggagggtttttagtttgaaaggataataccctatggtgaggtatgagcggaatcagtagtatattgtacttcactggagaatttgatggagacatgcttcccctggaataaactttatgtccctcattcaggggcagttttttaatggctttgcattgagcacaaaagatttagacaatttgcttctttgttttagggtagacacatactgccttttaaaggtaatattttttaagatgactgttagtaaattgttgaatcctcagcgtcaggcaaggaaggcaaacagtaatatcagagaaatgctacctgtgagcacattcttttgagtcattattaaatagacagtactattcatgtctaatctttgatcatggattccagactataatcagtttctcatgatctgttttattttgcttttaatttccctctgtgtattaggagtaactccctttgatgtttatctatgatccttttcacagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggtaccggcagttggcgatttgaggatttctttttatttattaaaaaaaaaaaaaaaggggttgaaaatccatttagtgcctagtcatgtttaatgctgagtctaactttttacctttgacagtgttctggaaagctgtttcacatctagggtttttaaaagccatgtagcatgaaactgctagcatcctaacttggttttacagtaaatactaggttcttggcattttttattatcataccattttatcagctcttcaaagaatgaagcaactaactactctatataattcaggccacatcctgttcaacttcaaggaagtatccaaattctttcatagtcctggaatttctttgtcatgaatgagtcccaggcttctttaaaacccatcactaagcaaccctgtgagccctcaccctctttggagagctgtgaaacttttgtttctatgccatgggaaaaaatccttgctgagaggaattttgggaggtaacagggctaaaaaaattctacgtgataaaggcttttaaaccaggcaggaatgattccctgctcatgtattatggcactgaatacaatgtttttggtttggggcctttatttttttcatggtagctgctgactattatgtgaacaaggactggaaaaaagtatctgtactgaattattcataatagaaaatttcattgtaacggggtcaacaaaacactaaccttggcttagatctatttttgttagaaggatatggttactgtaagggagctggaatggaatttgaaactggttctgtaatttatagaccacaacattatataatcattgtaatttatatttgaaacattcaggtattacctgtgtgatacatatactcacaggagattctgacaaaattggattatttccttactgaattttttttttttttttttttttgagacggagtctcactctgtcgcccaggctggagagcaatggtgcgatctcggctcactgcaacctccgcctcccgggttcaagccattcttctgcctcagcctcccgaatagctgggactacaggctcacactgccacacccagtttttttgtgtgttttttagtagagacagggtttcaccgtgttgcccaggctggtctcgaactcctgagctcaggcagtccgcctgcctcggcctcgcaaagtgctaggattgcaggcgtgagccaccatgccctgcctccttactgaatttttaatttatttgtattataaatgcctgtgttggttttttctaacgtgtttgcaatctgcagtcctacctgctacctgtcacccgtgttgtcactggggttaaataactgagtttaataatgggcctaatagttaatcaaaagtaaccatttttgaaaaattagtaatacttgcttctctcaaatacaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtagttaaatactaagcggacttgtttgtttttcctctaggtgacttgacttattcagtcggtagactatgatggcaccatattaaactgcatatatcatgtgttgcagtggttctgatagggcagttccatttacatgtatcacaggagctaataaaaagttattttcttctataattctacatttgatgaattcagtgagatacagaacaattatcactaagaaatgctaagcatttgtaataaaataccagtaaagtaggagcatgcaggtattctaaaaagaaccaaacaactgaaatctctaatcttttgattgcatgagctccttaagtagtagagagaacccactatgattagtgccaagggacttatatttagaaatagaaactttactgttggcctgattgaaaacacaatagaatactaatctattcataacctagaaagccccaacatttggtggttattgctgccataaggaacatgtgtgttcatagctcatcgatatctgttgactcactacgtagaggcctatttgctatttgcctgtaactagcaaatctttctgtgagctgaattttaaaataaagtgttatttcctgtatctatcttcattcattactttttggtttattttactgaggctattgaaaaaactattatcagacagtttatctcagattaatgccaatttccctgaatggtctaatttactcttctggcgaattaactgtagtgcagtaacttactaaccaggccatttctttttttattaaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgagtaagtatatgaaaattctactctgattataaaatactgtgatataataatatcatctataataacaatataatcttaagagctggaggattccatgtttttgagagtctagagcttctgtaatttttggatcccggctgggcacggtggctcattcccgtagtctcagctcctggggaggctgagacgggaggattgcttgagcccaggacttcgaggccacagtgagctatgattgtgccactgcactccaggctgagtgacagagccagaacgtatctctaaagaaaaaaaaatggccgggcgcagtggctcacgcctgtaatcccagcactttgggaggccgaggcgggcggatcacgaggtcagaagatcgagaccatcctggataacacggtgaaacccccgtctctactaaaaatacaaaaaaaatagccgggcgtggtggcgggcgcctgtagtcccagctactcgggaggctgaggcaggagaatggcgtgaacccgggaggcgcagcttgcagtgagccgagatcgcgccactgcactccagtctctgggcgacagagcgagactccgcctcaaaaaaaaaaagatacctctttctgagaaagaagacaaaattgcaagatacaagatgtagggccttggaaagggaagggactcgtgtaagggagaagcccaaagcttaagtttcagttggcttcatggtaaatttacctgtacttaaggattaacatcttgcttccaatagacctagcatcttagcaaaccttctgagaagcatcccgcagctgtggtttggggcataaagcctttggctctaggtttgcccacctgataaagctgactgtctcaggaacttgcattgaagaaaaacttcaaaaacatttacagtgaactttgctgattacgtagaagggcttaagtttttgtaatcgttaccagagaagctacactgtgcctcaaagaaccttacaactaaatgcaagtcaggaattgcagtttgttgcctgaaagcatgtgaagaggtaggaggctcattcagccagggtgttccaagagatagcatggagtggtggcccgggcactgtgctgtctgaacagtcacatcttgggagtcactgagaatgaaaggagaatcagctgttgagtatgttagggcatgtataaatgcattctcaattgcttgttcacttgactcggttgtacaagccatgaggggaaatgagatatgcagagatggcatgttgacaaacgcaaaatagtctttgaaatgaatcctgagttccttagtgtggttttcacaatgatacggtgaagcaaaggtacttctttctgtaggagcacacctctgaaattatcataaaagtcagtagaaaaaatgactcaatatacaaatattttctgtatagcttttctggaatgtgtcttatacataaagcttagttctcctgtagcttgaattgcttttcttttttgacagattcccttttaataaaatgaatgttagccagcagcatgattttgtcagaggaacaaaccttttcaattgaattacattaaaattctgttcttagcattccttttgctcattttagtatcgcaataggaaaggaataaattggaagttaatggaaagcacttcctttgcactgttttcaaagtgatcgcaggctagattgccaacgaagcaaaaaagagcacaagaaaagtgctgccatcagatgagactgggcaggagagctgctctgattctaagatcttcaggaggccgggcgcggtggctcacacctgtaatcccagcactttgggaggccgaggcaggcggatcacgaggtcaggagatcaagaccatcctggctaacacggtgaaaccctgtctctactaaaaatacaaaaaattcgccaggcgtggtggcaggtgcctatagtgccagctagttgggaggctgaggcagaagaatggcatgaacccgggaggtggaggttgcagtgagctgagatggtgccactgcactccagcctgggtgacagagtgagactccgtctcaaaaaaaaaaaaaaaaaaaaaaaaaagatcttcaggagatggtggcggcattggtagggtttcagtttagttgaaagtgggggaaacatagagaaataagtttttagtatagtctggtactcaagccctgctctccgggccatttttgaatatgtccttactcgttcccaggagttcattgtatggattagtgctgacacttgaacttcctacagcagatacagtggtttgcttatggcctacaaatgcattttaatcaagtttggaaaattagagaaatttcactggtggagctgatgtgggatagtataaaccaatttggattttttaccttttaaagaaatgatagtgcaaaaaagaagatatatttctctagtaacaaataacctccaagaatttcagacttaggaatcggcagactggctgaagtagaggttgggttggcaagccaatcttgtatataatgggaaaacattattttaaagaatgaaagattttaattaattaaaatacagcaaaatcacattttcaccaatacttattacatgtcatatttaaagtatatctattaaatcttataactagataaattgctgtaagggcaactacactattccaaaaagcattattaaaatatcttacaaaatatcaccctcacaattttatatatatccatatatataaaagaatatcatagtttaacaaaccagtgtttaaaaatgacttttctaataaaattagcagaaagactgcttttaaaaaccagcgttttgttaattttcctcataagctggctacagcaaagacgactaaaaaatgtctaagaaacctttatgcattttgcaaaataatgtgttaaagaagagcacttaacccaaggaattcagaatcatcgtgtcagaatgacaaatgatcattttttttcttcccatacattcttgtaatttggctgtgaaagagcaaaggccgcctcttctaagggtcagaaactttaaaacacattcaaaaggaaatgcacaaaaagaaaagggtggggggaggtgtcattatcaggccgcccctccagaagcactgtctgtgttcagacacagcagcacgtattgtctgtgtaagtttgagatggttaatgggcaaactcaacccctgtcgctactcatcagagccttgacaacagagtttctgctgcttgtctcccgacctgggtgtgcggcgggatgtgagcatcctaatagaggcagcggggggcttctgaatccccgtcggaatgcctttgtttttgtagttattggtgaactggccgactcccagaatattagtacgtgtctgtaatatttcccttcatttttagagtaccatgtgtctatgtgtctactttagaccttacaaagggcagcctgtaagttcacaaagaagggatttgacaggtttgacaatggccagagtgtcaccaaaaccacaacgagattgtgaaaaaaaattgccatcccccactgaaaaacacctgctttctgtgacttccatgacaccagtcccttgagctctgataacaggctctataatcatcttcctgcacaaatacctcgcacagaaaagttaaacttttcagctcaaattcccatttgtgtatggccagctttctgactatcctggtgtctaaaaagccttgagattaaagcttttgtaggatagaaacagatggaagaagatctggaatcaataaatttgcctactgataaaaatacacttgtcatagttccttccaaagaaattttaaaagagaattagttgcaattacttaccttacatgtttttcttggtacaaacttgagtgtaccattaacatgtcacagtattggtataagtacaaaatgaaatgtaaaagtatttcataaaatgcaaactcccattatctttgtggctcccaccactcctggaatgttgctgtgggtatagaactctcccaacagctatttgttgaatgaagaaatagaaaaataaatcagagatgtagacaggtcagtgtttatttgcagagaagagtctggtaaaaccagaagctggcatttgccaacgctccactgagagaacacctataaatgctcttttgcgttctaagttagttcacacctccgtaccaatactgaatgttgaaaatgttaacgttgcccatttttgttactgatttttaaaaatatttacccaatattgcatgtttgctcactgtattttgctttataaaataaggacttcctcagttgatcttcttattccaataattaaacaaaataataacttcctattgatagcactttcttctgaaatgttggtgttaaacacagaaaacttttcccatgcaaatacagttaaaggatattattgtatctggtatcaggaagaattctaggagaagaaagcctgattcccaataaggtttttatcaatcaccaataaagtaagtagggtgattcttcggggtacacagatggggtttctttagcatggtaactgtcatttcgaaaactagagatatcatctgcttcttggcggcagtttctctccatgttacttgtaattattatgtccctattgtgattcattagagaagtggccaatatatttagacatgctactggatggtatggtgggaagactacattaggtatcagatggtttataactcagctttgaaatcactgagttagactaatatgtttcacgagctaaataattattcattacggactgagtaaaccatcttggctctgacctcctcttccattgacttgctgggctgtagaaaggaccccaactagctaacagggtccccttgtatgaagacactgtgtcttcagtgagtattagggaccgcttcatgctgctcttcacaccacttaaaaacagtggccacacgcgatcattccttagccagagtaattccaaggaaaccaaaaagatctcacctgctaaatatttattatttaaaaagtttatgcctgaaaagaaaccgcggttcttacactcgaatgcacaaagaagtgaaatccagtgtattgaattggggaacagaatacgttatttaatagtaaatggcatttcacagttctctgcttgcttacccacatcaaatacaaaccgtttgggcatatctagaggctcttctgtctggttaaagaagacaacatgaaaaactatgaattctggccaatatgtacatgcacaccagcaggttagcgacatttttttaaatcttgggactttgaatatttggagctctgtatttgtggagctgactctgtgatcttttgtgagctatattcagattcacagagcaaataaatgagtttcagcttttacacattatgtaggtatatatgggtctccggcttctcatttgggtggtttattgtccctcattcaagcttttcaatttcagaatgagcttctgaaccatttctttataatgaacttaactcagtgcccatggcaaacccacgactcccactgacatcagttctcatgctgtaggagtgcctcagagaagggatccccgaagaggaaagacaggcaatgtgaacagcgcatgtgctacgcctaagcctatttcaagttcaaaactgtataccaaaagcacaaataatgcaggaaaacgcaatgataattattcattaattagaaaagatatcattaattagaaaagttatgcccattcttgttgacactgactcctattatttaaacagcctggctgcagtgccatgctgtgttctccttacaaaagtgaccactgcaatcgcttctaatgttagaagaattatagaggttatcggctgggcacggcggctcacatctgtaatcccagcactttgggaggctgaggtgggcggatcacatgaggtcaggagttcaagaccagcctggccaacatggtgaaaccctgtctctactagaaatacaaaaattagccgggcgtggtggcactcacctataatcccagctactcgggaggctgaggcaggagaatcgcttgaacccgggaggcagatgttgcagtgagccaagatcacgccactgcactccagcctgggtgaaaagagtgaggctccatcccaaaaaaaagaagaagaattagagaggtgtcttccacaggacaaaactgagaggatatcctttcctttgataagcatctgccatccaaccctaaaaactgaaacactgaaccttgcatcattgttatttctgccaaaaactgcattaaaaactgagcagcccactttataagtatatatgtatacacacacacacacttatacacacacacatatatatcttaaaatggtgctcagccacctgctttattttccttttcctttttctttcttcatgaaagaaaacatttaggagtttaagaatgatttgcaagagagtttatcagcagatcacttaaaatcatgggaaaattctatttttgatagaattttaaatatttgatttagtagaatcaaatagtttatttctatttttgatgttttgtttaattgcttaataatttttgctttaaattattaaccaaaacgtgtatttccagggacatcaataaaaaaatgcataggcaagtttctaaagtgactgctgtacatttcaagcattaacctgaacactatgaaggcaatacttttattaatacttgatctattccaattaccttctgcagtctagtttttaaaaatcattagttctgcccaggtttcaaaggagaaaaggaactggggaaagagtatgttgttcagattactcaaaaaattgcacaaaaaataaaaacagattagtcagattttctcagttcatcggctgtgtccctggagtgtgttgatagttgcaaggttgaattaactctttcagggtgttccatttggcaagtcaatattccggatgtgctaacttgttccataacggttcaagagtaaatgcagcttccacaagtgtccagtttcctctttaaactcgttctgcaactgtctagattagatgatttgatggcctcatatctgtgtgcatcatcagcttcccttacacggtgattgtcagatatttaccctaacactaagctgtgtacaccagccatttaaaacgattgataataaagcaataagtttacacatggacgatcagtgcaagagaacttttcatgttttacaatcacagaactgaagattgacaaatgagtgttttctggagactttgcagcatctgtggctcattcctctgacaataaaataaaagcaatgccagcagctctcactcctggatcccgtaactcctcagcctcccaggaaggtgttcagcacagagaaagtccctggcctatgtttcaggatcctagagtggtgtcagaatatcttgaggctgcaaatgcagaaccagtgtggacactgcacttctctttggagctctctctgggttggggaaggcagtctatgaaggagatagataggatggttggggatactatcatctacatgcttcaagtcaccctaactcctcacttagctacaccgccctcccctaccccatcatcaccactaccacttctcgtaaacacacgtactgatgatatacttcaaaaaagatttcctagacttcaagttcatcccaaagtttggtgaagccatggttcttcaagagagaccccccacaacttctagaaaatattgatgtaaagaaatactcctttgtagcgctctctaaaaactactttttgttctctttaagtgtattttaagagtgtaggtccgatataacttaagattttcccatgactgggctttttaataaaaaactgtataaaaagcaaaggctgaaaaacttatagtgtattttaaagtagttaattgattaagcatttaaagaatgtaagtcaagcatcagctagaagaaagatgtcattctgtttcaaactcaagaaaagatgggggcgggcgcggtggctcacacctgtaatcccaacaacactttgggaggctgaggcgggcggatcacgacgtcaggagatcgagaccatcctagctaacacggtgaaaccccatctctactaaaaatacaaaaaattagctgggcgtggtggcgggcatctgtagtcccagctactcgggaggctgaggcaggagaatggcgtgaacccaggagttggagcttgcagtgagcccagatcgtgccagcctgggcgacagagtgagactccgtctcaaaaaaaaaaagaaacgatggaaccaagttctaataaaggcaagcataagccttgccaaaattagaagaaagtactcatttatagaggatgatgtttttaagctaggtcagttagcgttatagtaataaaagaaaggttacaggaaccttatatctggaggagcagaatgtgagtgtctaaatgcatcagactattcctagagaagtcaaaaaatattcaggatgactaaacctcaaacctttaaaccctcaaggaaggtcagaatgggtttatgcagtggttatttataatttagagctagtgagaaatgttatgcccaggaatttatctttatgttcatatcggtgtatccatatccaatgaaagattagctcattcaccccttactaatttaataaagatttctagttttttaacttaatgtttaaagtgtaccccattctccttaacacaaacaattaaccacaagcataggtaatcccatatgggactggtccaggcaacaccagcctctgaggaagcacagtttccaaaagcagctatgccacctaaaagaaaatgaaagtcttttccatgctacattgcaaaggcaaacagattgacaaattattaaattatttcaaacctcttaggttttgataaggtgggaagttttctgtgctttttgatcatcaagcatttcctgtttagcccgtaatttcctggcattcattcattcactcatgtgctcattcattcagtaagaatttattatgtgccagctactggccttaggtgctggaggatgcagagctagatgacacattccctgctctcaaggagctcagagtccactgggagagaaagacaagtaaacagtgataagaatggtaagtgctaagatagttgttcgacaggccgtggaggtacagaggaggatcatctaaatccgattgagaactggggacaggatgaggcaagaaaaacttaccaagggaggtaatttttaagatcagtgttgcaagttgtgaataaaggctacccagaagagagagaaagagactgctaggccagaggaaagcatttacccaggagcagaacgtggcaggctttggaaagaacacacagctcagaatgacaggagcatcgaatgtgtgtggggaggagggagataagatgaaaccagggagggagatggtgcctctgcgcaagtagggcttgcaccgctacgtgaagagctggactgcgtggatcttccctccggggtaggcgggactctgttcaaggagtttaacagggacagcaacatagccaatctggtgacaatgtaaggatagatttaaggtagaaaagtaggttaggaaaggaaaggtaggaggcagtagaggtcagtcagtcattaggacatgaaatgtaacttgctgtctgaatgtaagaggtaagggcaaaagaggatcaaggatgagtttcctttttcccaacttaggtgactagtggacacggagatacggggaagaattgtaggttgatcaacaaaagatgagttccgattcgtaaattatgactttgagagtaccatggcacagtctagcatgtgattaaaaaaaaatgtctgattggaacttagaggacaattccaaagatgtggacacgagagctattgagagagccgaagctataagtgtgaataaaatcatattgaaagggaacatagaagatctggtgacaagtggaaaaaaagaaggtgcaaatatgtgagtttacagactggagtttcctgtggcttcataataaaagacaacagctgtgttaatactgaaggatccactttctcctactggatactctatccctaattttttgaaatcttcaaatctgtgtcttcccttgtattttgcatcactttctgtatttgatcttctttctttgctcccttttgctccttaactgcccaaatgtggccattcctctgcctccccttacttcttgcactttgctcaatgttcattttctctcttaaagcttgtgagtaggtaacatcttagtctccatattctctcatcttaggctttttttccttacccttcctccttactcacctccgtttcccaagtcattgacactcatgagatgaaactaaaaacctgggttccggtcgcgattgtgtcgcttactcctaactgcatgactgtgagagtcagagcccctgtctggattttcctgtcctcacctgtaacatgaaaggctccttagtaattaaaaatcacttcctattcacaagaaaatatgtgatttttaccatttccttccaacttctcataggcccctgtcaaggtgtattccaaaagaaataacacttaacaaaagttaccaaatttcctctgctaaaacagttatgcatattgcatattgcatttcggtcaaactagtatcttatatgttatgttggtggtagaaatagcaatttatagtaataaatagaattttctctttccaaatgtgccacctactttttaaaaatctttcccacttactagaagcctggcacagccctccttgtcctcgctcagtgccagggtgtggggtctgtgtacggctgaacaggcaccaggatacaaggagaacaaaagagaaggaggggtttgtcctctgagcacttccagacccatggaataaatccaggaggatgagggcatgcacagttctgttttacagattctttggagcaaaaattttcctcgccatcagctgtctaggaggtctccatttcaagaccagatagctaaacaaataagctgtatcctacccatgtcagccttcctcactcgataaacaatttaaaaaagaaaaaaaaaagacagactgtcttaaacatgattcttctcttaatgatggctaacccagaatccttcgaatccctaagggaactaattctggaatgccctgacttggatggctttgtctcaaggcctgtgaatttcagagctgggcattatcactttgtcagttctccctgatgtggtaatgactatgaaaggaaagaggcattgggtcactatttttgaatttgattcttgaagaaaatgtcatttctgtgaccatctatcactatgctcagcgttcaaaagggctggaccagagaggagtgggggaggctctgcccttgtctacatgcctctgaactcatgttagctggggggtgtttgaaaaaaaaaagaatagcagcttgactgcagactgctaccctttctggttttatggagcaaagcacgggtcagaatttgccccatcagcaagacctcctaattaaatgcagcagcaacaaagacattcgcattggggttaccaacacccaccccatacaattctcacccctttctcatcaggatccccttagcaccaagaccaaactcacgtaaaataatactttcttttgtcttccttcttttgcattttccctgccatttttgataataggtaggtagcaggcaggggagtatcaggtggtgccatgatgtgggcgtaggcgactgctctgtttcccttggtgatagaagcattttctatccagaacctgatttttgaggatttcttactaccttgctacaaattatgatttgtctttgagatgataattgttaaaatacataaaccataggttccttctcagaagacttacatgtaaaatctttcgctgttgctgttgcaaatcacattattgccattaagattccgcatcagcccgccgttccgggttcgctgtttgtgcacaagtccctcctcaggaaggacgatcaaggagtgatttatgcctacatgtttagtcatgacggggttagtagttgtgttccacttcacctcaacaacagatacgaggctgttacaaattagcaatgtgggaaaagtcttgcggtaaccggtgacaagatggaggggattgtttgtttttgttgttgttggccgttaaactatggaaggaaatttgagcctacgcaactctgttagatggaagaaaagattctccctctgtataaaatgtgtgtgtgtgtttctgggtgggtgtgtgtgtatattacatacacacgtatatacactacgtatactatatatacacatcacacacatacacattatagtgaaagtgggagaaagatgggttaattaagtccttcatgtgagttcttactgggatccaagtctgaaagcaaacccgtgtaacccacgaagcagctctcaaaagcaggctagctctgggatggccctgaggaagacccgaggaaggcccactcatgaggaaacttgaacatttatcccatctggaggccttcagaatgaacccaaaccaacatctgctgctgtcttgcctgcccagaacaggcttggttttgaccggagaaagcagtcacatttcagtgactctcactccggcttccctaggtgaaaatgacagaggtgtggggagggcattgccgccagtatatacgtaacgacatatgctggtctcgtgtttgagtcgggccagttcagggtcaggctgaattctggactgacaatccacagaagggataaagagcacgtcactccgcaaaagagcccacctccagagttagaatgacttctctgccctggtgtatgcgcttctctaaagctgtgctctcatttacacgtacttttctcaaaagcagaagataattttaaaaacataacctttggttaaagaagccattttatggggaagcaccaaagacgataaatactcctgttgtcaagttgtaaagaaagttttcgagaactgcaaattgtttccacttgaataaatttgcaacatcaataggctgttgacattgggttggtaacagtctaaatcacttgattttactctcagatgagcatctactgaagatgtttaagtagaaaggtattataatcatggtgtttcagattgatttggtatcagtgaatatgggaagaggcagatagacccattttaaaagtctagggaagctctgggaatagaaagataaatatctgagagacattaccaaggaaaaggagaaagttaggagcttcacgtcaggttgaatatagcattctcagctgagaatgactgaggctgtgattctccgaggcatttgtcgataatcccactacttaggaaactttaaaaagagatttaaaaatataccacaaaagctaaaacagcaactaggcaaacatgcaatccaaattaaagaccaacaaacagataaacatcaaataagggcatctcatcagtggaagagcggtaggtcacggagagcctgaggaagtttgtcctttccagcgagagtcctttgtaaagaggggtcaggcaggagcaggaaggaatgtgctgtgttatgaatttgaaaccatgaggctaaggccagaggaatgcaatggggggcatgaagttgatgttctattcaaattccctggagcctattgcattgtacattcaaaaagctaataaaggaaaactacctctcaaatctataagctgggcagggctagttcaccactaaggccaagcaacgttcagttgagtcacacagttgcaaataagcaagagaatctgaatccgcccagaggcatatctagttgttggaaaggtctttttaagacctggagtcagagtatttcagaggctagctggacattcgtgggtgcattggttttcttcttttgtggaggtaaagaagagttagcctgatgtttatggaagtacctgagagtcgtctttgaagacattttctttcactcccttagtcagagtccccgggtcatttttctgatgtctttccttcatctcgttttcatttctgttgacataggtgctaatctgtgaaaaagtttttactcgtccgcactgaaatgaaaaaaaaaaaaatgatgtggagaatgttttcatcataaagctttattcattgcttttaaagagcagtcctaggccgggcgtggtggctcacgcctgtaatcccagcactttgggaggccgaggcgggaggatcacgaggtcaggagtttgagaccagtctggccaagatggtgaaaccccgtctctactaaaaatacacaaaaaaattacagaaacagtggcaggcgcctgtaatcctagctactcaggaggctgcggcaggagaatcgcttgaacttgggaggcggaggttgcagtgagccaagatcgcaccactgtactctagcctaggcaacagagcaagactctgtctcaaaaaataaataaatacataaataaagaacagtccttttggccgggcgtggtggctcactcctgtaatctcaacactttaggaggccgaggcaggtggatcacctgaggacaggagtttgagaccagcctgaccaatatggtgaaatcccgtatctactaaaaaatacaaaaattacctgggcgtggtggcgggggcctctaatcctagctactcaggaggctgagggaggaggattgcttgaacccaggaggcggaggttgcagtgagccgagatcatgccactgcattccagtctgggcgacagagtgagacttgtctcgaaaaaaaaaaaaaaaaacagttcttttgaaagaactcaccctacaggtaggtcccgcctctctttgatatgtttaaatggccttatgaaacgatgggagtaacgggtagtagtttttaatttaaaaaccctgtgttgatccctgatttttttcatggtttgtaaaattggcaagtcagggagccactctcacccccaccttaggttcctcgttaaaaccccgctttctttaaaccttcttcagcacctcatgttctccagtgaggagatccacccaaggctcccttccagtatgactctgtgctggccactgtgcctcagccgggcccctgcaccccgacaccttcctccgcagccctcccagccccacccgggcccctgcctgactgcctgatcccacagtctagttcaccactaaggccaagcaacattcagttgagccacacagttgcaaataagcagagaatctgcccagaggcatatctagttctattccgggacctggccaggtccccacctgggtgcagctcttccccagctatgtcagcgtgaacacatctccccttctgctcactctggtgagtggtagcctcacaggacactcatttgtaatagttaaattgtcacgtatatgacctctgctcacccagacttctctgttttcacaatatcctcacgctttagcttgcacggaaaggctgttctgaaactgttgggtgccgggttagataggagctctgaggaccctgacaccggagcagccttccttgtgcaaacacttcagccctgttagtgcctgcacttagcttcagctactccttagaaggcacaaattcagaacttccagggctaaactgttaagctgggccgctaggatcccagcttaaccctctgtcattctaactgtactacctacaaaggttacttgtatttttatttcccaaagaaccaaaggctaataggtgagagtctgaactttcagcttcctgggctgtatctccctgtgccgaggatcctgtgatatagaatgcctgcccagcagggaatggaatgtgtggtaagccaatgaaagagcaaagtcagaggttgcagaaatgctttctacaggagaaaggtgaagtttctgcttcagattgaatggggctagaaaatataaaccagcaaaagggtcaaaaaagggcagaggagaatgaatcagcaagctgcttgcaggtggtacaatctatataaagctagagttcccagctttaaatcaggcactgtgatctacaggagggctagtgggcctggggtcagctgcacaaaagtcccagttatggtccagtcaagagatagcgtgagagccagatcaaatcagctaaccacgtcgtattttcattttccgtctctgaaatgggggggggggaaatagtacaatacagaattctcctatgtagaggcattcaaaagggcattaattttttttaacccgatagcacgttcttcacatcataccatgagatgtgtaatctgctgcaagacttatgccaaactgaacgacagaactttaggctggttttgtcaataattctgtaactctgcgctgcttgttcttaaataaaccagtgcgtgtttgtttcttcaagagcagtaatttcttcaaaaaagcgatcacagcaataaactctgttggatttctttcatttatgccttcctttgctaggggcgtttgggttggtggggaggacatcttcagctctgccttttgtgagtctaaacaatgattccacttaatggtgcattggcttcctctgtgtctccatccctggcttctccctcctgagtgcccgttcctgccgctggctgagcagcgtggcaggttgtcagatcatgtcagtcaaacccatgatctgaccgatactgtccccaccgaattaatgggatcagctcatcaccgggcacggaacagacctccgtccctcgccttcctcctctctttcttccctctctctactgtaacattgtcctggcggagtcttctctgtctttatcacctagaatcttctcctgatgaacaaccacatttttcaaaatgaatgtttcacgaaaaacccctatcatctcataaacaagtgaaattgaaaaaacaaacaaaacacctctatccttttattcccaaatatcactcaagtaccttttttactcctcactcctgtgtggccccgtgttttcacctacgattatgatcccctgtcactgttttcctgccctggtaacctgtctttctctaacagcattgtttctctgttagttctgtgtctgggcttacttcaagtaggatgttgattcaggtctccatctcactgggaaccttcgattagtgaagcagtcttagaatcaatctgaaatccaccctttagtatattgtggtcccaaggaaactcctaatttctcatccagatttttgcttttttttttttctttcttcagacgacaccatcatttttgaaattttctctggtgctgccacaaatagaaaagtcacaaaaattcaattcttcagtcaaatgttgtatctatgatgcatatttatgagcacagaacagcttttaaaatgtattttaacactcaaattataagttactcttgtatttgtctgctaaaaagagtaagtgtgtaaaaaaaaaacaaataatcattaaatgtcaggaaatattgcatctcatttcagtgaacacagtaaatcaccatgcaagatattccccattctttcaatatcactgtagacaagatgggttatcatcaccactgccagcattcaagctctaatttaccattatgaagtatgtcaatcactgagaaataagaaagtctttaaaaggttcttattttattaatttgttgaagatgtctgaagatactaaaaggattttttacatatgcaaatacatacatgcacgtaaacatactgtactgtactgccaccgagggagtaagtcagtaaatctttaagaactgatgtaacagtgaattaaatctactttgtagaaaatatgaaggaatactaaggaatttaatatcagcaaacatgttccctttgaaacagcaaattagatgtgcaggaggattttggtcacacttcaaagaatcatgtgctgagatggagagctggtctgtttactcgtgttctcaccggtgaggtttttctatgttaaacgggtttttgattacttcaaagcatgtttgaagtcttcactctgcatcgctcatccacgaagacaaatagtcctccaaatttgtgcaactaatattgctacacattatatttataagtcagaagaaactgcagtttcctatttaacaccaagttaatgcctcttgtatttagctatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaaggtaaacacgaaagcatcattttaaacaagtaccaccagcacccagacagaatgcggcaacacccactttccaaggtgaaccagaaaagggaaggtgaaaatgtaaacctctagaaatattggtgacataatctacagtgtacatgtaatatttatttacttgtatagacatattttaaaaccacatataagataatctgtcatccttggaatagtgtctgtttccattcccatgtattaaaacaacttcattccagcccttcacatgcatcatcaggcgatttttgcatcacctaagagttttccagagcaggtcttctgaccgccatctaagtacagtagtttgagacacagcactttttgaggccatatgtgatgcagtattttaatctgcatgtcatggaaattttatcccaaattccaactacacattcatgtaatgcctggagtgtccattttttcattccatctatagtcatatagatgccatatctccataatggaccctccttgccatattcctttctaaatttgaaaaagcctgtctacaatgacatttgtaattgtgagttcacaactctaagaataattactaaatctgtattcaactttttgactcattttttttacctgttccatgaagtaatctctaaccatctaaaactgctattgcttgaattcattccttccccaaatggtcctatattatttcaaaattttaaactgaggcagtagtctacaatatgagcttttttgtataaaatataaaatgtcttcctttattgaagtcaatttcggagggaacattgctttctatttttggtattcaagatatagatattaatcctttcaaaggatctttgacagaagatgcagggattgggtgcaggggagggaagtcttccaagaccttggaggtgtgtacaccgcgctcctgagagatcacatatgtgcctctttacaaaatatttacttagtgcacatcccatggaagctgagctctcatttcatcaggcaaatgagaaaaagaagtctattaaactgcagaaggacttcaaattcccctaaagtttgcctttaatatttagccaaacctctgacagcatgaaatgccaaggatcaaagttgttttgtttctttctaaaaggacatcatcaggtactccttattcctagtcaacttttagaaatttagaacctatctcacggcacaaccggccaagtatttaatccatatctaatagttcatgttttgtgcttcttgttctttagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggtacgtacgtgttgtggagcaggagatagctgcagccctctgatctgtgcagatcatcctgagggcaggttgcgtctcctgctcacccccctatgtctacactgagtatgagcacctcgctcagtgtggttccaatcccacatgggcctgttctggcaggtgcagctggggaggctggagggaggtcaggtcgtgagagggctgagaagaaaaagcaataggacactagagggaaaaggagatcaggagtgaaggtaaagccatgaccatgaaaaccagctccagacatcttccaggtcactttcacagagctatggtccattcccaaagcggactccagctgctgctctttgttctgctgagccccagacactgccgccacctgcatccccgtttgctgcctctactcactgctgcttcccagggcccctgctgccttgggccactgcaaacgcaaggctagttcacaggcctcctcttgctcagctgtcctgaagcaggggtcacatgcacgtgtgcacacagcgtcacacctgttctcagatgcaggacttcatcaaaagacacaaagacatggatgacagctgtgcccctctctctgcataccaaagacacagcacctaactagggttcaaaaaattatgggttccagatgaggctctactttttgctaatagtaaaccttatgggagaatcagaacatctctgaatctgtttccttatctatatcatggtatccatattatgatatagattacacattatctaaataccataacaagatagataggagatatgtagatgatagatagatagatagatagattatatatatatagatagataggagatatatatagataggagatatatatatagctatattgcagataaatgaaatttaccctatactacctctgttttacacagttgttacaagaatcaaatgagataatgtgaaagtactttgaaaataggctgggcgttggtggttcacgcctgtaatcccaacactttgggaggccaaggtaggcggaccacttgaggtcaggagttcgagaccagcctaggcaacatggtgaaacccatctctactaaaaatacaaaaatcagccaggcgtggaggtgggtccctgtaatcccagcttctcaggaggctaaggcaggaggattgcttgaacactcgaggcggaggttgcagtgagtcgagatcgcgccactacactccagcctaggagacaaagcaagattctgtctcgaaacaagaaaagaaaaggcatggttatatattccctgaccctaacgcagatagcctcttctactcacacaccagatggataggaaagggctgttgagcttgctggatagtaaaatttcactggaaagagggaggagggggaaatactttgtccagaaactgaccacataaccataacatattgcctgctgttcttggagacaagttataagtaagtgtgcactttttttttctttgtaatactgctttgcaagacataaaaggaacttaggcagatgagagggaaagagaggaaacccagtctgaagtccctggttctctgcctaatcctaaatgaagaaaatacctcacttgaggaaggaagaggccagtgcacacaggcatgggtgttactttctttctaaatggcagagccacaatgcctcagcaagacgttttagaaaatacgctatttaaaatggcctgtgccatcccactgaaaggagatttccagctgatatgtttgattgctctcggagagacaatgccaagatcacaagggagggcttcttactttcaagataagattggatgtgccagctctgactgctaatttcattcctctgtggattctaagggagaaattctagggagaaagtgatgatatgaaaatctggtttaaggactgagcctggagtctgccaaaatagagaagaggggagagaaggggaagacctgagcccaccaagacagtgagaatcagcccaaagagccacccatttctcttccactctttcctgagacagaggatgccacctctcttaccttgcattatttcctagcagaatgtcctgttcatttttaagttgttgacctaaatttagctatgtgcctgtcacatggtggacactcaaatatttatccaataaatgaaagaatgaggaaagccagcctcacaatatgaattctctctgtgccattgcacctagatcttcccaagagaggggctatgtgaacacatccttgcaaatgtttgactgctataaatctaacactagaaataataggttaaatggagataatagagatatcattctctctgtctatacataatgtgtttatgtgtgtgtgtgtgtgtgtgtgtgtgtgtgtatttcttttttttttttttttttttttttttttgagatggagtttcactctgttgcccaggctggagtgcagtggtgtgatcttggctcactgcaacctccacctcccgggttcaatcaactctcatacctcagcccaccaagtagctaggactacagacacacgccaccatgcccggctaatttttgtatttttagtagagacggagttttaccatgttggccaggctggtcttgaactcgggacctcaagtcatctgcccgcctcggcctcccaaagtgctaggaatacagcatatatatatatatgctgttatatatatatatatatatgtttaaaaagtaaaaaaggcagggagtagaaatggaaaaatcatataagaaaacagcaatgtaaaaagcatttctgtgaaacagtacattaggggacaggctggacacagcagaaaataacaagcacaggaaactgtgatagagatgtaaggacgcagaataaagacaaccattctgtacttacttgtttgcagctcatttttttaaaaagacacatagatagcagttgcttacctgtgctttataatatttactaaatattcctaggttttatcagggctggattgtagaacctgccttcagtcaattacaaaaaattgtcatggtgttctaataataaaattcatcccctaaagctgcccagattcagaggcttagagaaaaaaaaatcgtagtgaatcattttaaaaaagaaaatctcaaaatttgaaagccaaacgtgtgtttaaaggcatgcataaatatgatagtgtatttaaatctcattatgccagtcacatttgcgtagtggcctatttctcactttaatctgagcggcacggcctagcgtgggacggcacaatgcacttggcacctgctgatggagcaggcacacaaaacaacctgtagcaagttgatgctctaccagggacaaaagagagtcttgatatcgccacccagtgtactggggaatgagcctgcccttccttacttccccccatgacatcttggctaagtgagtgtaattccatctgctggtatcactccctgggaaaattgtgtagcgtcatattcttttcaagcatattccagagggaagattatagctgcctgctcccaacatcaaagtgatgttgtgattaattacaatcatgctggacatgatctttgaaaatggagatttttttccatgcttacttaaaggaagtatacatcacaaaggaattcatggtgatctcattcatacacaacaaatggattcattttcatatagctggaggtgtagcagcgatctgagataaggtttcacttttagattgttatttaagtgtgtgtgtgtatgtgtgtgtgtgtataaatatatatttttttctttttttttttaatgtcttgaagaattgttagtacttttagttttattttagagacagattttgttactggttttactaagaacaatgtgttctttttttttttccttttcttttttttttttattatactttaagttttagggtacatgtgcacattgtgtaggttagttacatatgtatacatgtgccatgctggtacactgcacccactaactcgtcatctagcattaggtgtatctcccaatgctatccctccccgctccccccaccccacaacagtccccagagtgtgatattccccttcctgtgtccatgtgatctcattgttcaattcccacctatgagtgagaatatacggtgtttggtttttttgtacttgcgatagtttactgagaatgatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttatagtcctttacccagtaatggggtaatgggatggctgggtcaaatggtatttccagttctagaaccctgaggaatcgccacactgacttccacaatggttgaactagtttacagtcccaccaacagtgtaaaagtgttcctatttctccacatcctctccagcacctgttgtttcctgactttttaatgattgccattctaactagtgtgagatggtatctcattgtggttttgatgtgcatttctctgatgtccagtgatgatgagcattttttcatgtgttttttggctgcataaatgtcttcttttggaaagtgtctgttcgtgtccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcgcatgcctatgtcctgaatggtgatgcctaggttttcttctagggcttttatggttttaggtctaacgtttaagtctttaatccatcttgaattgatttttgtataaggtgtaaggaagggatccagtttcagctttctacatatggctagccagttttcccagcaccatttattaaatggggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgaccagtggtttgtagttctccttgaagaagtccttcacatcccttgtaagttggattcctaggtattttattctgtttgaagcaattgtgaatgggagttcactcctgatttggctctctgtttgtctgttgttggtgtataagaatgcttgtgatttttgtagattgattttgtatcctgagactttgctgaagttgcttatgagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcgtccctgtcttgtgccagttgtcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattcttttttgttgtgtctctgcctggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgtgtagaggtgtttgtagtattctctgatggtactttgtatttctgtgggatcggtggtgatatcccctttatcattttttattgcatctattagattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggaacaggttgttcagtttccatgtagttgagcggttttgagtgagattcttaatcctgagttctagtttgattgcactgtggtctgagagatagtttgttataatttctgttcttttacatttgcagaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaaccccggcctttttttgttttccattggcttggtagatcttcctccatccttttattttgagcctatgtgtgtctctgcacgtgagatggatttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgactttgcagcagctggtactggttgttcctttccatgtttagtgcttccttcaggagctcttttagggcaggcctggtggtgacaaaatctctcagcatttgcttgtctgcaaagtattttatttctccttcgcttatgaagcttagtttggctggatatgaaattctgggttgaaaattcttttctttaagaatgttgaatattggcccccactctcttctggcttgtagggtttctgctgagagatccgctattagtctgatgggcttccctttgagggtaactcgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatacggtcttttcacatagtcccatgtttcttgggggctttgctcatttctttgtattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttcagcacttctctgtattggttattctagttatacattcttctaaatttttttcaaagctttcaacttctttgcctttggtttgaatgtcctcccgtagctcagagtaatttgatcgtctgacgccttctactctcagctcgtcagtcattctccatccagctttgttctgttgctggtgaggaactgcattcctttggaggaggagaggcgctctgctttttagagtttccagtttttctgttctgttttttccccatctttgtggttttatctacttttggtctttgatgacggtgatgtacagatgggtttttggtgtggatgtcctttctgtttgttagttttccttctaacagagaggaccctcagctgcaggtctgttggaataccctgccgtgtgaggtgtcagtgtgcccctgctggggggtgcctcccagttaggctgctcaggggtcaggggtcagggacccacttgaggaggcactctgccagttttcagatctccagctgcgtgctgggagaaccactgctctcttcaaagctgtcagacatggacatttaagtctgcagaggttactgctgtctttttgtttgtctgtgccctgcccccagaggtggagcctacagaggcaggcaggcctccttgagctgtggtgggctccacccagttcgagctccccggctgctttgtttacctaagcaagcctgggcaatggcgggcgcccctccccaagcctcgctgccgccttgcagtttgatctcagactgctgtgctagcaatcagcgagactccgtgggcgtaggaccctcccagccaggtgcgggatataatctcctggtgtgccgttttttaagcccgtcggaaaagcgcagtattcgggtgggagtgacccgattttccaggtgctgtccgtcacccctttctttgactgggaaagggaactccctgaccccttgcacttcccaagtgaggcaatgcctcgccctgcttcggctcgcgcacggtgcgcgcacccactgacctgcgcccactgtctggcactccctagtgggatgaacccggtacctcagatggaaatgcagaaatcaccgtcttcggcgtctctcatgctgggagctgtagaccggagctgttcctattcggccatcttggctcctcccccatattttttttcttgagacagggtcttgctgggacgcccaggctggagtgcagtagtgtgatcttggctcactgcagccttgacttcacaggctcaagtgatcctcccaccccaggctcccaagtagctgggactacaggcacctccacacctggctaatttttgtatttttctacagacaggatttcaccatgttgcccaggctggtctcaaactgctgaccttaagtgatctgcctgcctcagcctcccaaaatcttggaattacagacatgagccacccctcccggtcttaacctgatatttttaataataattaaaaatatttattaaaaggctaccagaagaccagacgcagtggtttacacctgtagtcccagcactttgggaggctgaggcgggtggatcacctaagcccaggagtttgagaccagccagggcaacatggggagaccctgtctctactaaaaatacaaaaattagccaggcgtggtggcgcacgcctctcgtctcagctactcacggggctgaggtgggaggatcacttgagcccagacagtcgaggctgcagtgagccaagatcacactattgctctccagcctaggtgtcccagccagaccctgtctcaagataaaaaaaaaaaaaaaaaaaaagccactgaagcctggaataatgctggtactttatgactgtaacaaaaaaaaaaaaaagacttgaaaagttgccctgacatcataaagatgtggtgaagcaagaccatgtcctggaacgcaggtgccccttgtctgttcttttgttcacaacacccaaaggagaaggtccaggcatggtaagggggtgaaaaacatgagagctcttagtatcttttgaaatgttccgtactgaataacagagagcggtgtctggaaacagtaagaatggttaaagccttggcttgtgttgggaatttgggaaaaaacatagccacattctaactcattcctcattactttggtttgaggatacaagaaaggcacggcatccagtatttgtctggataaaagaaaaatcataccttctgtccagatgctgggtctcactgcttccaggtgcttgtccaaggcacgcacagtgatggcatcatctgacttgcatctgggtgtttcggtgtcgcctagccacactcacaaaccaaaggtgcaaatcggaagccagggctgggcacggtggctcacgcctgcaatcccagcactttgggaagcggaggcgggtggatcacctgaggtcaggagttcaagaccagcctggccaacatggtgagacccccgtctctactaaaaatacaaaaattagcaaggtgtggtggcacatgattgtaatcccagctactcaggaggctgaggcaggagaattgcttgaacctggaggaggaggttgcagtgagccaagattgcaccactgcactccagcctgggtgacagagtgagaccccgtcttaaaaaaaaaaaaaaaaaagaaatcagatgcccgagcagcatggggttccatgcctgtctccctacagcagcacgtcatatccactctgtggtccagatttcccatactccaaccaggggaaataccgcagagatgaaggagggtccaggaagcagtaaagaattaatacaaattaaaatgaatgccaaggaaaatgcaaacacatgggcaataataacatggcagcactgtccctggaagctacagtcagtcttctgtagttcctccaaagcccgggataatctaaggaagaaaaaaagggcaaccttaaacattcagggtattttttcctttcaaaacacaatcacaggcgctcaagagccctaagaaaaccatttaaattgtgcaaaacctcttcttgaggcatccaaaattagagtgcaggtataagctgaagaacttgattctgccatttatcactttgatacaaatatttctacagactttaaaatatatatatgtaactagccggtagcttctttccaaggtacacaaagtattctacaaagctcaactcataaagtttcacaaaattcacataaggcagggagcaactgatatgcagacagttccgcatggaagctcagaaagcctccagctggctggtcagaatcgaataaaactcactgaaagacagagcctaagggatctaggccaacctctttatttacagatggacaaaacagactcagaggggttgaaagccaaggtcaggctgcttcaggtctggagatcaggcttcggactcttgggttcctcccccaaccaccactccggactatctgctgtgacacggtgttgtggggtttttgcccacatcagctgatagaactgaaaagttaagatgtaatttctaggccaggctcggtggctcgtgcctgtaatcccagcactttgggaggccaaggtgggtggatcacctgaggtcaggagttcgagaccagcctggccaacatggtgaaaccccatctctaccaaaaatacaaaaattagctgggtatggtggcaggcgcctgtaatcccagctactcgggaggctgaggcaggagaatggcttgaaccccgggaggcggaggctgcagtgagccgagatcgcaccactgtactccagcctgggcgacaagggcaaaactccacctcaaaaaaaaaaaaaaaaaaaaaaaaaaagatgtgatttctctccagggctctgcctccttatattttgtaaatcagctctctgggtgcttcccaccctcaacatcattgctttttagcttatcgagctgccattccacggacttcaccatactccccttgaacagccaataggaaaagtttaagcttaaggattatttttgcatgggacatgtttaatgtgaatgatagaatgcaaaaggcagttttattccaaattttacaaatatatatgatgtatgtatatacacatatatttatatataaacgtgagtggttgtgtgtgtgtgtaaaattggtcagctggatctgtccactttgaaggttctagctagaatatggttatgtaaaattaagatgttcccatttaatttttaacaatcaaaacagttaatgagcattttggaatgtacaagccacccctcccacaaaggtgctgtagaagaccagagaatgaataggccatggtctctgcccttcagaggttcacagcctgcaaacactggagactattggtaaagcagaatttaatcgggaccacatttctattgcaataatgaaggctgggttgtgtatgcctcggatggcagacggtaacagccagatttagtccaaggctctggacgtggcacctagccacagagactctatgacaacacatggtgctgaatttgtcagataagtacaatattcggatcatgtgtatgtgttagtaaaggactctgaagtccctgccagttaaccagatcttctccaaagaaagacgccttctcaaaaaactgtgacgttgcagcactgggccaaaagcaatgatcttgtttataacctgctgctattgaaactcattaataatttacagtaatgtgggttccaacttctacttaactgctcttcaaagggccagagtcacattaaccgctgtgttttatttaatgtagccatgattaatttactaagcaattattttccagtgtcttttgggggaggagcttggagtcatatgaacaggtgtcatgtttatcacctttagagctcctgaacaaactttaagacacatacattttggtatttttcttatcagttgctttagtttacaaaatttaattgaaatggttttgaacaaatgccaggctgtctttctgcttaataaaacattttaaaagagcagttaatctactgccttgcacttgtacccaagaagttgctaagttaatttactgacaaagagaatcaatcatcgtaaatggtgtttaaacaatactggggactccggtgttggaataacatgatttattttatcatcttgttggtgttgtaacaggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaaggtatgcctgcaaactaagctcaacaatagggaaaggataattcacatttttcagcaatcatccagagcactaaggggaaaaaaaacagtggcacatgactgagttccatttgttattcgaagtatcaatacggaagtcacattggcacagcagtgatgaatttctgcattagcaaagtagtttctccttagttaagttctactgtctgagacccttttaagtgatttatgatgtaaacaaataagcattaacgttgtccacctgccaagcttacacattgacaacattcacaaattagaccttgagcgtgtaagtcgcttgtaaataattttcgtgctagctcttccatttaagagagagccttacattagcacagttaaagctgtcagctttgtgttattcctggcagagcttcaacataatcataaaaagcatgtagatcctagttacgcattattaaccaaaagaggcgattttcttagaaagccacactttcgggtactctgtggcatctttcctttcttctacatataaaaggtaagcctcctagattaggctgttttccattcttgagaactatgcatagtatcaaaaatggagacttagaattacacgtgtgcaaaatgctaagttgtatgctgtgcggcttggggtattgactggggtcagaggaaatgaaagtaaaagaaagggaagaaaaaggaaagaacaatctccatgtaattcctttcttaagaaatatccaccgaaaagcatattcatggaatgtttcatttgcctttgagacaaaagttcgccctagaaaatgattctgttttgagttccggtagctctcagaccccagagcatggcaccaccagttacccagcagcgcgtgctacacactactcggcagttactgttccacccctcctgactgaaacgttgcacagaggaactcttgtcacccaaagaaatcacatcacatccatgttgtcactgtgctcccctcacacaatcttgttctttaccagaggtgccctggggaatggctcagtctaaacctaaccccctgaaccctgagccatcccaactaattccagccggcgcctgcacaggctactcttcctgagaaccagtttcagttccaaagctcactgtaggatgctacctctcttacggcagccccccacctctgggatgcgtccagctaggaccctcatggccaatccgtcctcttgcaaactcacctgtccgctctcatcagaagagactcacccttgagacaatgaaccacacctgttagatgacaagcccctaacgcaatgtttctaagtgggagaggatcatggcttcgttctggagcagttttcccaatttaaattcagtgcattacagagaagaataacagaaacatacaagcacaacccttaaaatgtatagtagtgatcataatggcactgggaaatgtttagagggagcccaggagcatatcattgagaagagccgctgtcacagaatgacaaaggcagtgaccaggatcacctgcatgcatccaggaggatcagaaaagacaacagacagatctttctcatcgtctctcccaaaacccatcaaatccacccagactatttcgatgttcttactgggataggtgcactaagccaaaacttactcatagcaaaacaagtaatattttacagaccaccatcaaatatgacttcagatgattccaaaagtaggtattcatgtgaattcggcaaagtccaagctttccttggaacaatgcaaactattaggaacaattctcaggacatttactacacaacctgcatgcaaaaattgcccctgggtctgcccaaagaggagattctacagaagctgaagtcaggcaaaggagaagtcccagcagggctcccaagctccacatcctccctgtgccaatgatgttccatttggcccagcgggttagaggaagcttcctcagagggaagagtcacccacagccctgtgttactgctgagcttgacttaaccagcctgggatgaccttctctcacatttgttggcctagtaactgtcatttgtctttcggcagtggctcatgaaatagagttcacttttaatacatttactcatttcataatttagcaccaaagcagtatgtagtccagaaaccatccttattgctcctgagatacaaatcggatttggtatccacagaaagaaaaggagattttattgtcagtacggatgccttgtaacaatttgcctgtatgtgtatatataatatttctattaagggcatttatagctctcattcaccatgtgattaatttcacaatattttttggtgtcgatgctttgtatacactttatccatttttggctaattttatgtctttatacaataatattgtgactgctttgcccctcccccaagtacactagaaattaaacatgatttgagtggttcttcactcagatgagggggggaaagccaccttactaaataattgctaattatggatagaactgcattccccatatgctcttttctcctcaaaatattgtctgtaaagcagctttgatcatgcctgtattatgactaatccagatccattgacaaatctgctggttggctatgaatgtctgggaaaataatggtactgtcgtgacaggcagcacattgtgaatctcgagccactaattgcagaacccctcacaattaagcatccaagcaaattaggcagagaaacgttaacaacacgcaaggtcaaggataactcaattaaaatgaaaatcattttctctagtggaatgtttctgtgcatctgtggtcactaaatctgcttttgcatctcccgttcacaaacactgagtaacagtatgttctctctttacagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacaggtaagcattttgattccttcccaagagctggaggactaccatcattagattaatacacaaaataactggaaatgcttttttaaaaaactttatactttactcaggcaaaggcaaatggctaaccttttaaatgtgtttatttctttatggaaccatagagaaatcacaaagggaaaatgagacatatttacttcctattctgcctgccattgcccaaggccacaagtttttgaaatgacatgtactcagtcatttaaagaaggggaacatgggggaccaaaaaacatgatgaacacagagtcccaaaattggagtcccaatcccagctcctctcccacaagttgtgtagctctgtaagcaagccatatgttttttgagtttccattcccttaactataaaattgggataataatggctaacttagggcacaaatataatacatgaaattctgcaacagatagtaactaccttacgaatgtgtcatgttgggtttttttaatacatgtgtgaagttctcatggagataattaaggtgaaacacaatacaaggtgacaccatttcatccctgggaggtgtttaattcctgcctcaccaccattgcctcaggacagtcacgaagccatttctcccatcagttgcttagacaatggatcctgtgtctggactcacttctgtcttcttacatcactgtcttcattgccagtgcagttcttgcatggtgacaatactaataggcatactaatttttccacgaatgtgggataattttcagggtacagatttaagatctttccaagtttagtgcatgctacctttttagttatgcaagatgtagaacatcagatcccacttctgccaccatggaacaaccagcatgtgaaacagacaaggtccttgcaagcattactctagttccctttagtgagctgacttcttcactcaacctctactccaagaattctgaatcctgctgctcctaccttccattcctgatatacagcaccatcattaacccctctaccacatttatatttccaggaggaaggttctttcctgttgtcttttttttttgggcttgatttaaggtattttggttttgttttggcttgtgttagatgctcctttaggctgcctcttttctagctcaatatttgaggcatactgagatgtctgttctctcagttctcaaaacagctctcaacaggttgccccctgttcatttcacatctgcttcctacctttccagactgtctaaagcatttcatatctcttccatgtgaaccagctgaaagtccctcctttctgcctcctgattcagcagcacccttattctcattcagggtttttcaatacacatctgccttcaaaccccattattttggcagtacttttcaatacttacggtcctctgattttcactgttatgcagacattgttcagagtaacagaatttttgcccccaatactccaacatttgggagaattttctcccaaaataaggccctcccacccccaaactcatatacactcttacatacacacaaattgtgtcactttgcatcctgtgtgaaccacttaggatttatgtctccccaccaccactactaccaccccatttcaaataaaaagaataccactggttttatagccatatgatgcctggacgaatgacctgccagcctggcaatgaggtgagagtctgtgccctagagaaggaaatgggaatcaagtggctctccatcattctgacaggcagtttaccactggttatttaaggggtgttgacaggggctgactgaaagtctggaaagcccacagctcctgaattcatcctctcctagcaacgtggactgcagggaatgccatagcagcattttctgaaaaacatcaaaagagagatggaacagcataaaatatattaggtgaaatgcaatttcaaattttccagcaatgtgcttaatatataaaataatctacacccaaccgttctcataaagctgcaagcctgctgagtagttctgtaacattataacctccagaatagaataaaagccttattctgagctgaatggcttttggagtcacatggcaatattttaaaataccaccttaaaggtttccgggttctctccccaaaaagtttgtctccacctgtgcacagtgagcctttgaagtcacaactgatggtaatcaggacttctgggcccttggccagttttgccagcttgcagcattcatctttgattaagaatcaactgttgattttaatactctcaatttaggggttttattaatagaaaatgggttgtggaagtccgcatatccttgggcaatcgctttggagagctaataacacacaacttctatttgagaccagccttgaccaactacaaaataaatttcgtttcttttctacaagtatgtctctctcctgctgctgtgcattgttcttacctttgctagcactgttactagcacaggctgcaacttagcaggactgatggcttacccagtctgtctgagcatctattactcgcatttttcgtagcatttgccatagttctgctgtgaaggttaccgtcttcatgtctaaaaacagtaggtttagatttgtaggacgaaagcaaacaggtgctctttttcagattattaattgtgaaattggattttctttttaaggtaagaatttaaatttatgaaaggacaaaacaaactccaacacctttcattctgaacattcttctcctagatgttaacagctggctggtgacatttggtttccatctgcacaatgctattcctggattccctgttcccaaatttgatttaacagaaccttcttacgaacttgtgaagagtcagcagtgggatgatataccggtaagaaacaaaaagacctacggaaaggtgataagtagcttgtgtcttatctacccatatctaatcaaactacccttgtgaaaactgtaccaaagacagtttttaactttttgactgttttagggaaaaaaaacaacacttcctctgcatttgtgttcaacaaaccagaggcctcttaaacaggcttaaatatgttttcagcaatgctaatgaaaacatagaaatgcagaagctcactttcgagtgctgggtttctaaaaagaaccccaagaaagcgtggacctgaaggcaaaaatacaataaacaaaagggcagggaactcatattacaaattagcaaaccacaaacaatgccacaaggttcaacttctttaaaaattaacagtgttttggccgagtgagggggctcacgcctgtaatcccagcactttgggaggccgaggaggtcggatcacctgaggtcgggagttcgagaccagcctgaccaacatggagaaaccccatctctactaaaaatacaaaattagcccggcatggtggggcatgcctgttatcccagctactcaggaggctgaggcaggagaatcacttgaacctgggaggcggaggttgcagtgacccgagatcacgccattgtactccagcctgagcaacaagagcgaaactccgtctcaaaaaaaaaataattaattaattaatagtgtttcataggaaaagattaaaaataaaaataaatgtcctctggtaaggctccacctacaaccaggaaggtttatggaattttcctgagaatagcagatcaagaggcctgtaaccattataagaaataaagaaatataatagaaaattgcaaagtcaaagctgccgcttcagaaagtggtacttctaatccccaccagagaccagaaaggaatgcacagcaaaacaccagaatttccagcttacagtaagaataattagagatggagaaactgggtgactccatgatcataaggagaagacagtgcagactttcttaggacaattaattcccaaccaccccttgagcaatttcctatcatttcaatgaaaacaaagagaagaggcagccatggttaacacacacacaggctatctacagtaccagtacctgttttttgttgtttcatacctaatataaaagcaattcctttttcataagttacaaatatagtcgtgtgtgtgcaacattttggtcaatgacagaccttgtataaggtggtgatcacataagattacaatatcatatatatttttttttaattgaaatggggtctcactgtgtcacccaggctggagtgcagccttgacctcctgggctcaagcgatcctcccacctcaggctcccaagtatctgggactacaggcacgtgccaccacacccagctaattttttattttttgtagagataagagtctccctgcgtagcacaggctggtcttgaactcctggtctcaagcgttcctcctgcctccacctactgaagggctaggattacaggcatgagccaccgggctctgccaacactgtgtttttactgtacctcttctatgtttagatacacaagtacttaccatggtgttacagttgcctgcaatattcagtacagtcacaccgtatacaggtttgcagcctagaagccataggccatcccatacagcctacgtgtgcagtaggctacaccatctaggtttgtgtaagtgcccgctatgatgttcacacaaggacgaaatggcctaatgccacatttctcagaatgcctccctgcggttaagcagtgcatgactgtctacactgatacagtggcatgaagacataccgaagtttcctaatgcatttgaacatgcacttcctaattgtgtatgactttccaacatgcctgaaaacacctacatctaactgtacaaatggacttgccagctcttttcctaagcagccttttaaatatggttcaagttctctgtcaaaagaagtgcaccataaggacagcataggaaatcgtgggcaaagacactgaggctgccccaagtacagaaaaacaactgtttctttcattgccgcaaatgaaacagatgttttcatttgggaaacaatggccagacaaacatctggtggtataagaaatggctgagttaagatgcccccaatttaaaacatttgccagtctagacggtccactgtccctaagtctgagaaaaataattgttttcctaaagtaacaaatatcgtctccagctgccccaccttccactcatccctgtacatttcagttctgcggttacactcaccatcttcagctgaaaactctgccaggagaggggacagagttgacttaaatacaagcatttcaaagcatacgaagcggggccctgtgatcggcactaagtatccccagccgttcagatccctctctgtgtttggtggcttctcagcctcctgtggagaaagctacgagcatgcagatccggatgagctgggttccccacgtggggtgggagtgggaaaagagcatctagaaactgtaagagaaaagcaagaaacaggactatttttcccatgttagaaacgaagaaagctttaaagtgatccacgatgagtgagccatttgggggttccagagcatcgggatcaccttgagggggagggatctcgagtgctccctccacccgggctgtcagccttctggtcagggaaggaccccggggcttccatgcatgccccggcgctgcccccagagtcccgtgtgtgggtcaggagtggggaggctcccggccgcctctgacgcgccccctcttttgtttcgcccgcagcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgtttttatattttttcaagtcttgggctagccagcattgcttttgtgtttaacgtggaggacgcaaatagatgcagttgttggggaattgattcatctgcaacccagttggtagtatcttttttttttttttttttgtccattggccagactgctggctcagcagagtgaacttcacaggggactctcccatggcctactttagaaaaacagtaaacacacccccacaaagccaaacacgctaactgtaaagaagagtttacaaaaataccacccattactacttgagagcaggcctcattcctgtgatcctggcaataagtgtgcttaattaaaacacttgattagaataatcagtttgggcctggtaggcttgcagcctcctggagatgtctaaatctacatatagaccggctgattagaagatgcttagttcagcaattctggccggcaggccagggctttgattttagtcggaagaggcagacttcatcacacttgctttctagtgacaacctcaactgcataacgtgttgatccagcaagaatcaggtcattccacttggcaaactggtctgttttcttctcctcgaattagactttaacatgatcaaaacggaattccagaaaaacaggcgaagtactgctttccttctctacagtcttttccttaaaagtaatgtctgaacaaatgcaaataaaaatggtgccggtaaaaattataccttagaaaaaataatctgaatatgggatatgctgctgccacatcccgtgaaatttgtctttacattcaccacacatatcctaacagttgcatggggttctaactgccagaccgcaacagaagggcagcacctgactgtaagtacttcaaaatcaggaccagtcctcaagcgcttgaaaagatgaggagaggagctggaggttacaacgagctatgatcgcagcactgctctccggcctgagcgacacaagacccagtctcttaaaaaaaaaaaaaaaaaaagttttttaatgaaagaatgccgttgatgctttccctatccgtgcccactcttcactccgttcaccatcttttctttctccttttgccctgggctactcctgaatgcagttgtttctctcgcctgctgacagcaaatcagctgtccgaggtgcttttggaaaggagggattcaagagaggaagccagaaggcactgatccacatcatgttctgtctgggtaaaaccacccgggcagtgctcacagccgctcgcttgctgttgtacagaggaggacaaggtccacctggaccaagaactgccaccacccatctggccggggcggggtgggtatcatttgatctccagcagagtggggtgagtctgcccctgggaagcctcgaagggcaacatattaagatctcacccttccatagatacccaaatttcctcccactttccttcaaggagtgatctgattccagcatcccagtccacaaaatgcatccccattccagaagctggaggtggaatggaattacagaaatgagttgtccaagttcacagaagtggcttaagttaaggtgagcagagattccctttgctagtaccctccactacatcacagcctcctcataacgctccccgggaagataccgcaaatactccttaccgccccccttcccatgggcacttgatctttccaaagctgccatcatttacagccaggactagcatttttcattctataacgatccgccgacactaaacaaaacagatgccttgagtgccccctctgcctgccagtatttctagctcctcacgcccttctgtgtaggtaagccaagtttgactctccatcatttccaaaagaaagaccattgggctgtttacctagattttccataagttattcatctggctttgaacatcctactagacccatgaaaaaataaaataaaaatgagttataactcattatcacccattttaaccacagagttaagccagagtaccaaacaggtactgataagccatttgaattttctaccttctcatttaagccacataatgaatgtcctctgtttgccagacttctcatttgctgttcaccacccctgcaagcaatggtctcttgatgttagttaattactaataacttttaggtaaattgagtaaaccttttcatttatgaaccgacttagaatcctgtcgtggaggaatacgggattcctagagtcccgtggatagagaatttactatcaaccgattctaagcctagagtaacatcattattcagtttagagttaatgggttcctcaaagcaaatttaataaatccttctgggatctaagctcaggaaaattaaaattagaagcataaattgtcacttttagggcaagagactggcttggtaacagtccccctgcttacagggtgaattgtgagctacgcttagccctggccacaggcattcatcctgtattatgcagggaaatctcgttcttccacctgtgtgcagagatttcctgaattccagccacagcggccatttctctatggcatagctcgctgcacacaactgtcaggatttacaagcggtccgctgggtcaaaatgaatttttaaaaatgttcacaagtgaactctatcaggggagagtgcggggagcataaatgcccaaggacttaaaatgacaaattctcgggcgtgactgaaaggctgaaaatggggcgctcagtggaggtcggtgaggaggctcaccaggctctcttcaacctggagttcttctgcaccgtggttaatgaccgtaggctggagactgccccatcccacaccttcctcccacacgaacactagggaaagtctagtctgcctgttccagagaaaattctgcaaaaatcgtccccagaactatctttgcatccacgatgctcgctctctctctctctctctctcgctctctctcgttgcaatgggtcaggttgaatctaaccctctctgtcctttaaggcttggaaggaatgccatagggctccctcggtgggccagggcgacgttgatgactcaggatctcaaaaggacctagagccagtctgtcatccccagtttcttaatttattgacaaaaggtaacgaacaagcagattgtaaaatatctttattcagctatgacatgatttccaagctcaaaaaaaaaaaaaaaaaaaaaaaatcaagcctggcgtttaacttcagtctggagcattgacaggtgacaggtcactgcagaacacagaggtgacccaaggcagagaacgggaggtagcgagaggaagacgacacccttccctgagtcctccctcatctggggcttccctctggccttcccctggggttcctgggactcggcttctgcggacatggaaaagccgtcccaacatccggcggccccgtgggcaggggtcctgggacgccccctcctgcatccccgggcgggccctgcaggggatggcggcgatttcaggaagggctccggcgccccctagtgacgcgcggctgtggtagggaaagtcctgcacgccaaaagggcagttcccgggccagaaaccgaggtgaaaccgaagagaaggcgccgccgctcgccgctcgccactctccaccccaaccgcggcggggccggctctctgaccctctcttccccacctctgctctgccctccgagtttcacacttaaagcggagacttctgcttcagcaccgccgcaccgaggcctgggccctgccaaagtggctcgggtaagatttccctgcacgtcgagcagacactgtcatgccgcgttgctctcactcacagatcgaaataaggcccttcctcccgggaatcgtccgcgggctgagttccgcagcgcctgaaaacagtgatttctgaactatcatattgtttcccttttacttttcatgttaacagtcctgtcgctggaaagaatgtcccggaagaacggatcacttaaattcagagtggcatttttatttctgagggagctgggctctcacggaacgtgctggagtgacagcctggaagagcgaaagccgccccccctcccgcttccccgcagctccccagccgcctcggcctggcctccctgcagcggtgacatccagtctccctcctctacccaagcctgcggcagccacgaaagccaccgcggcgcagaagtggggagggattcaaccttttgcccctgggttgtcgcccagagaagccaatggatgctaatctcatatagcagcctgtttgctggtgtcctgccttcagaaaccggccgtgagtgagcccgctggcattttgggaggccaatatataggccctttttcctacccgggttctcgctgaaatgagtaaggccggagatggctcaggaaagccaaaatatcacctagataaaggccgggttgggaagcagcaggcacagctgcatgggaaatcccaaagggccactaacgggacaccaagatagatcagccaggcgctggcagcagtggcaggatgacgggagaggccctgctccctgagctggagcccagcgtgcccatgcccagttcgttcctccccactcaccaggagggcaaagcgctcccctgcccactgggagccgggatgaccaggaggcccggagtgagatatctgtctctctctctctctctgtcacacacacacacacacacagacacacacacacacacacacacacacacacatatatcaccaaggaggctgtgggctgtggcactaggagaaatattgcaccaggtctggagccccgggtttgcggatgctgcccccaccgcctgtggccttcagccaggttgcttcccgccctgggcctctgccgaagccagaggcaggggctctccaccggcagcagcgagcgcctcgcctgctgtgacaactctgtctggctctggggctgctcgggaacccggtcctaaacacaagttcttgggtcgtaagcacaggctggcagtcccagatcgggaggccccatgcatctgctcccgacctgagtccctcgccctggctcccactccgccaccccatggcgctgcctgcgagaggcgccggagccaggctctggccttttccgaggcggctgcctgccggttcctctcgcgcctgttacacggcggacggcaggctcccgggctcttgtaaatcaaagggcaacaggactcgcctcgccaccactcaggctctttctgcggcctctgccaattagtgctccagttaatcacacttagcaactccctggagaagcagcgaagccgggaggagcccagcgtgggagaccccctcaggctggctctgccgagacggagatgaccactggcctctgcgccttggtttccccatctttacagtgaacccagaccttggtccccagccgcccctccccacttcccgtgccaagacgctgcatgtgtgtgcacacacacacgcatctgtgtacgcatgtgtgcatgtgtgtgtgcatgtgcgtgtgtgcctgcaagtgcgtgtatgtgtgcatttctgtgtgtgtgtgcgtgtgcatatgtgtggggtgtgtgcacgtgtgtgagtatatgcatgtgagtgtgcacacgtgtatgtgtgcctttgtgtatgtgtgtgtgcacgcacatgtgggtgggtgtgtgcgtgtggatgtgagtacgtaatgtgcgcgcacatgtgtgagtgtatgcatgtgagtgtgcacgtatgtgtatgtgtgtttgcgtatgtgtgcacgtgtgcatgtgggggtgtgcgtgtgtggatgtgtgtacataacgtgtgtgtgcatgtgtgagtgtatgcatgtgagtgtgcacgtatgtgtatgtgtgtgtttgcatatgtgtgcacgtgctgtgggtgtgtgcatgtgcacgcatgtgtgtgcatgtgcgtgtgtgcaggcatgtgtgcatgtgtgcatgtgcgtgtgtgtgcatgtgtgtttgtgcatgtgtgtgtgcatgtgtatgtgtgtggacagaaaaagctagaagaaagagcccatggtgatatcaaggctaccacccagacgtctttcaccatctcctgggaaagtccccgagctgcgggaaccccagccacaaagctcagccacatgaagaggccccaggacgggaagggggttgctctccctgcagcccccacccaccagggagggaagtggcgagcagggctccctggcacctcctcacacttcctgcaggacagagcctagtagctgccctgtccccaccccagagctcactgctcgccgtttgaagatgatgcagcctgactctcgggcgtgagtatttgtaaccgcacaggaaatgacacggagcatggcaacctgcaaacacagccctgccagcatcccatgctttgccctgctccagaaaaggaaactcgaggaggaaggaagtgggcagaggagacagcacagggtccctgggtccatgcctgatggtgcccaatgttgtccccctttttctggcagccttaaaggctagaactggactgaaccccaagggcacgcctcaccagttctccctcctgggccctgcctggtccctggcggcatcaggcctcgctggtcatcaagttcaagaccctggcagtgagggtgcccaaaatggtggccccctgaaaacaggccaagtccagtgccaaggcaagtgaaagggttctgcctcacagtaaaaaccaccccatattggtggttttgccctgccatttcatagtcccccagccccacaaaaagacaaggatcctttctacttctgcccacagtcacttgtgagagccagggccatgacccaaccctgagtctgtcaccacccccacaccttcccagggatcctgggcagggacaggtggaatgcaggcagggcaggagcatccccgagagggccctccagggggagcactgcttactttacaccctcaccatacacactcacaccacacacacacacaccaccacacacaccacatacacacacaccacatacacacatatcagatacacaccacacacaccatcacatacacacacacactctcaccacacaacacacacgccctcacaacacacacacacatcactacacacacctcctcaccacacacatacaccacacacacacagaccccacacaaatatgcacaacacacatgcacaccacacaatcacacaccatctcaccacacacttaccaacacataccatcaccacacacacaccatacaaacacacacacacaccatacaaacacacatacaccacacacatatgctatcacaacacacatacacaccctcaccacacacaccaacacacagcacacacacataccatcactacacagacacaccctcaccacatacataccacacacacacaccctcaccacatacatacgacacacgcacacaccatcaccacacacaaatacactcaccatgcacactccctatcaccacacccaccacacaccctcaccacatacacacacaacacatacacactcaccacacacacactgtattagttcgttctcatattgctgtaaggaaatacccaagactggataatttataaaggaaagaggcttaattgactcacagttccacatggcttcagaggcctcagaaaacttaaaatcatggtggaaagggaagaggcatgtttgacatggcgacaggagagagagagaatgcatacatagaaggaactgtcaaacacttataaaaccatcagatcttgtgagaactcactcactttcatgagagcagcatgggggaaaccacccccatgatccagtcacttcccaccaggtccctccctcaaaacctggggattatggggattacaattcaagatgagatttgggtggggacacagagccaaaccatatcattccacccctggcctctcccaaatctcatgttctcacatttcaaaacaaacaggccttcccaacagtcccttaaagtcttaactcattccagcattaactcaaaagtccaactccaaagtctcatctgagacaaggcaagtcccttctgcctgtgagcctataaaatcaaaaacaagttagttacttcctagatacaatgggggtacagacatgggataaatacatccattccaaattggagaaattgcccagaatgaaggggctacaggccccatatgagtctgaaatccagcagggcagtaaatcttaaagctctgaaatgatctcctttgactccatgtctcacatccaggtcactctgatgcaatgggtgggcttccacagctttgggcagctccacccctgtggttctgcagggtacatgcccctctggctgctttcatgggctggtattgagtgtctgcagcttttccaggtgcatggtgcaagctgtcggtagatctaccattctggggtctggaggatggcagccctctactcacagctcctctaggcaatgcccagtggggactctgtgtgggggctctgaccccacatttcacttctgcactaacctagcagaggttctccatgaaggctctacccctgcagcaaacttctgcctggacatccaggcatttccatacatcctctgaaatctaggtggaggttcccaaacctcaattcttgatttctgtgcaacttcaggcccaataccacgtgtaagctgccaagtcttggggcttgcaccctttgaagcaatggcctgagctgtacatcagccccttttagccacagctgggatgcagggcaccaagtcctgagactgcacaaagcagcaagcccagcccacaaaaccatttttatctcctagacctccaggcctgtgatgggaggggctgctgtgaagacctcttacatgccctggagacatgttccccattgtcttggcgattaacatttggcttttcattacttatgcaagtttctgcagccagcttgaattcacctcagaaaatgtgtttttcttttctatcacatcgtcaggctgccaattttccaaatttttatgctctgcttcccttttaaacattagttccaattcccaaccatctctttgtgaatgtatacaaccgaatgcctttaagagcacccaagtcatctcttgaatgctttactgcttagaaatttcttccaccagataccctaaatcatctctctcaagctcaaagttccacataattctagagcaggggcaaaatgccaccagtctctttgctaaagcagaacaagaatcatctttattccagttcccaaaaagttcctcatctccatctgagaccacctcagcctggatttcattgtccatatcactatcagcattttggtcaaagccattcaacaaatctctagcaagtttcaaactttcccacattttccttccttcttctgaatcttccaaattgttccaacctctgcctgttacccagttctaaagtcacttccacattttcaggtatctttatagcagcacaccactctctgtggtaccaatttactgcattagtccctttgcatactgctataaagtgttggctggccgggcatggtggctcacacctgtaatcccagcactttgggaggccaaggcaggcagatcatgaggtcaggagatcgagactatcctggcgaccacggtgaaatcctgtctctactaaagatacaaaaagattcaccgggcatggtggcaggcgcctgtagtcccagctactcgggaggctgaggcaggagaatggcgttaacctgggaggcggagcttgcagtgagccgagatcgcgccactgcactccagcctgggcgacagagagagactccgtctcaaaaaaaaaaaaaaaaagtattggccaagatggggtaatttataaaggaaagaggtttaatttacttacagttcggcatggctgggaggcctcagggaacttacaatcatggcagaaggggatgggaaagcaaggcaccttcttcacagggtggcaggaaggagaagttccaagcgaaggggaagagtcccttataaaaccaccagatctcttgagagctcactcactatcatgagaacagcatgatgggggaaggagaaaaccacccccgtgatgcagtcacttcctaccaggtcccaccctcaacacatggggattatgggaactacaagtcaaggtgaggtttgggtggggacacagtgaaaccatatcacacgcacagcacacacacactcaccacacacacaccctacacacacccttaccacacacaccacatagagacacacacacctcaccacacatgcacactcaccacgccatcacacacacacaccacacacaccacagagacacacacttacctcgccacacatgcacactcaccacaccatcacacaccctcaccacacatgcacactcacaccatcacacacacacaccacacaccacatagagacacacacacaccctcaccacacatgcacactcaccacaccatcacacacacacacaccacacatgccacagagacacacacacaccctcaccacacatgcacactcaccacaccatcacacacacacacatttctgcctgactatagcaaggcaactacttgctgcccctgcccctcagtttcctctgtgtttaacattctcccctaccccatccacctcccttgcctgagagtgcctgaatgagaggcagcagacccagcatcccctgcactgttgctagagaggcgtctgtgtccagggtgggccagggccgggtgggaaagccagcttctcagagcactgggtcactcacgatatccctggtcaggggttctctggtgcccagttcctaggaccgccatggagggttttgcaagcagggggacccctcaggactggctgtcaggagggtggaggaaggggcctctcccccagagaaagtgctggggcagttcctggagcccactgtgccattacccatcaccatccctgggcacctccatcagagggtccaggatgccaaagggaccccacaggggaccaagtctaagaccctgtgagacccccgtccatggtctgccactagtttttagctgtggatcattttgtcaatgaaatctcacaagagggcaaagcagacacaggcctagctgcccagatggaagtaggagtgggggtcagaccgcccaacgtgttggcccccaagtctatgagtggcaggcacgcctgagcatgtgcctgtgagagtcaccgtggaaggtgccagaaaaaataaccctgtctgtcaggcctctgagcccaagccaacccatcgcatcccctgtgacttgcacgtatacgcccagatggcctgaagtaactgaagaatcacaaaagaagtgaaaaggccctgccccgccttaactgatgacattccaccattgtgatttgttcctgccccaccttaactgagtgattaaccctgcaaatttccttctcctggctcagaagctcccccactgagcaccctgtgacccccacccctgcccaccagagaacaaccccctttgactgtaattttccattaccttcccaaatcctataaaacggccccacccctatctccctttgctgactctctttttggactcagcccgcctgcacccaggtgaaataaacagccatgttgctcacacaaagcctgtttggtggtctcttcacacagatgcgcaagaaatttggtgccgtgactcggatcaggggacctcccctgggagatcaatcccccgtcctcctgctctttactccatgagaaagacccacctacgacctcaggtcctcagaccaaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacatgttttatccgtgtacccaaaactccggcgccagtcacggactgggaaggcagccttcccttggtgtttaatcattgcagggacgcctctctgattatacacccacgtttcaagggtgtcagaccacgcagggacacctgctttggtccttcacccttagcggcaagtcccgcttttctggggaaggagcaagtaccccaaccccttctctccttgtctctaccccttctctgcttttccagggacagggcaagtaccccaaccccttctctccttgtctctaccccttctctgcttttccggggagagggcaagtaccccaaccccttctctccttgtctctaccccttctctgcttttccagggacagggcaagtaccccaaccccttctctccttgtctctaccccttctctgcttttctgggagaggggaaagtacccctcaaccccttctccttcacccttagcggcaagtcccgctctcctagggggcaagaaccccccaatcgcttatttccatgccccaacctctgatctctgcgccccaatcacttatttccatgccccaacctcttatgtctgtgccccaatcccttttttccacaccccaacctcttatttctgtaccccaatcccttatttccatgccccaaccctttctctgcttttctggagggcaagaaccccccaccccttctccgtgtctctactcttttctctgggcttgcctcctttactatgggcaagcttccaccttccattcctccttcttctcccttagcctgtattcttaagaacttaaaacctcttcaattctcacctgacctaaaatctaagcgtctcattttcttctgcaatgccgcttgaccccaatacaaactcgacagtagttccaaatagccagaaaacggcactttcaatttttccatcctacaagatctaaataattcttgtcgtaaaatgggcaaatggtctgaggtgcctgacgtccaggcattcttttacacatcagtcccttcctagtctctgtggccagtgcaactcgtcccaaatcttccttctttccctcccgcctgtcccctcagtaccaaccccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctgctccggcttacagtttcgttccgtgactagccctccccctcctgcccagcaatttactcttaaaaaggtggctggagccaaaggcatagtcagggttaatgctcctttttctttatcccaaatcagatagtgtttaggctttttcatcaaatataaaaacccagcccagttcatggctcattcggcagcaaccctgagacgctttacagctctagaccctaaaaggtcaaaaggccgtcttatgctcaatatacattttattacccaatctgccccggacattaaataaaactccaaaaattaaatccggccctcaaaccccacaacaggacttaattgacctcaccttcaaggtgtagaataataaaaaaaaaaagttgcaattccttgcctccgctgtgagacaaaccccagccacatctccagcacacaagaacttccaaatgcctgaaccacagcagccaggcgttcctccagaacctcctcccacaggagcttgctacatgtgccggaaatctggccactaggccaaggaatgcctgcagccccggattcctcctaagccgtgtcccatctgtgcgggaccccactgaaaatcggactgttcaactcacctggcagccactctcagagaccctggaactctggcccaaggctctctgactccttcccagatcttcttggcttagcggctgaagactgacactgcccgatcgcctcggaagccccctagaccatcatggacgccgagcttcgggtaactctcacagtggaaggtaagcccgtccccttcttaatcaatacggaggctacccactccacattaccttcttttcaagggcctgtttcccttgcctccataactgttgtgggtattaacagccaggcttctaaacctcttaaaactccccaactctggtgccaacttagacaatactcttttaagcactcctttttcgttatccccacctgcccagttcccttattaggctgagacactttaactaagttatctgcttccctgactattcctggactacagccacatctcattgccgcccttctccccaacccaaagcctccttcgcgtcttcctctcatatccccccaccttaacccgcaagtatgggacatctctactccttccctggcaaccgatcacatgccccttaccatcccattaaaacctaatcacccttaccccgctcaacgccaatatcccatcccacagcacgctttaaaaagattaaaacctgttatcactcgcctgctacagcgtggccttttaaagcttataaactctccttaccattcccccattttacctgtcctaaaaccagacaagccttacaagttagttcagaatctgcgccttatcaaccaaattgttttgcctatccaccccgtggtgccaaacccatagactctcctatcctcaatacctccctctactacccattattctgttctggatctcaaacatgctttctttactattccttgcacccttcatcccagcctctctttgccttcacttagactgaccctgacacccattaggctcagcaaattacctgggctgtactgctgcaaggcttcacagacagcccccattacttcagtcaagcccaaatttcatcctcatctgttagtcatactcctattcactgttctcaactactcacacatgccctgctcttgtttacactgccggtttacactctttctccaagacatcacaggtgatatctcctagtgctatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccgtatccaggccatcaccaatcattctatatgacaaatgtttcttcttacatccccacaatatcaccccttaccacaagacctcccttcagcttaatctctcccactctaggttcccacgccgcccctaatcccacttgaagcagctctgagaaacatcacccattctctctccataacacccccaaaaatttttgccgcctcaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggccctgccccgccttaactgatgacattccactattgtgatttgttcctgccccaccttaactgagtgattaaccctgcgaatttccttctcctggctcagaagctcccccactgagcaccttgtgaccccccacccctgcccaccagagaacaaccccctttgactaattttccattaccttcccaaatcctataaaacggccccacccctatctcccttcgctgactctcttttcggactcagcccacctgcacccaggtgaaataaacagccatgttgctcacacggagcctgtttggtggtctcttcacacagacgcgcatgaaactgtcctccggggtccttggtccaactaataggtggacacagatcctttgtcaacagagcagggctggctgtgagcacagagtaggaacctcagcgctacctggggggtcaggcaggcttcctggaagacgtgaggctgtgctgggctcgaagggtgagcagcagtgccagtgccagggagaagggaggctgaggctgtacagagggagagctgtggaggtcaaggcccgggctccagggccagacttcctggagcttgtcccagcttcttcccttaggagcttcatagacttggactagttactccacctcgctgtgactcaatgtccttttctgtaaatggggcgttgcggcccaggggctgtggtcagatgaagctgcttagagcacatggagtgcttggagggggccctgagtgcagggggttcgtggcgtggctccgggctttactggggaggttggttccaggctgcctggagcccagcttctgcgggtcagggccacactgaggatgattcctcctggccctcagcccaggtcagacccaagaccatatgcagcgggcacacctgtgcagggcaccagcaatggtgcagggccgctgatgcgtccctggggccatctccgcagtgctggtccagggcggtcccacaggccatgttctggaacacgggcccttgggcatcctgtgaggctccccggcctcccgcaggtaagtggcttgcccagatccacggagggtggggagctcgggctgaaatcctactcagatgaccccagaacccatgctcttcccactcaccttgttgctcccatgccaggcattcagggccctgagtcacttcaaaggcctgccccactccctgtccaggtcccaatgtgctagacacatcctcaaatccagctgagtggagtgtctcccatttcccaagaaatcccatcccctcccatccctgcactttgcacgaagcaagtgcctctggactggcgcctgcttcatggtgccatggcctatctgggcctggcaggtgcacttgtgtcttgcccaagtcgcaagcaagtccagctccttggcacccaccaggcactcggacagtgcggcccaggggtgtgctctgagctcagaaagccgctgccccatccagacacatggcatcctcagtagcttctgttctgcaaaacatccagaaccctccggatcattgacctttatttaaaaaataaactgaaaaaattttaaagtcagtcgtttatggtgtagaaagaaacggtttaaattattgaagagctacttaacggttgaagtgaagcccgtagcaggtgacgcgtgactgtggtgcctacgggccactgcaagctgggtgcgaggagcatgcccagaccccagacagagcccagaccccagggtccatccaccaccaccatccggccagggcttctccgctggccctgcgacttcaccctcaggggaggcgtctctctcctggcagactgctcccattttgctctgccctctcctcatcgctctctcccggctggccccattagggagccgaagcagactctattgttcacagaaatggaatcatctgatgtctttatttatctattttttttaagtcagtagataaaaatgttctgtccctctccgactgggcaacagtgtgcacagtgctgcctgctggaagcttctgagggtgcagctcacctgagactgacctccctcccaggcccagtgggctccctcatggccccagggctcaggatccccagtctcccttgctggttctcgtcttcattcattcccgccaggaggacggtggaggaaagggtctccccgcaaaggagatgtccatggctgctgggggcctgctgtgccatcgcccatctccatgcctggcatagagggggaagggaaacctctgccctctgaagttttgctgaaaaatgaactcatggccgggcgcggtggctcacacctgtaatcccaacgttttgggaggctgaggctggctggcatatcacctgaggtcaggagttcaagaccagcctgaccaatgcggtgaaaccccgtctctactaaaaatacaaaactttgccgggcatggtggagtgtgtctcacctgtaatcccagctacaagggagactgagcaggagaatctcttgaacctgggaggtggaggtggcagtgagccaagatcacgccactgcactccagcctgggcaacggagtgagactccatctcaaaaaaaaaagaaaagaaaaatgaattcacataaggcagagtaacaggagaaaaggcacacaaatttatttaatatgtgtacacaggagccttcagaataagatgcacagatgaggggaaactgttttatgtttaggtacaacaaattatggacagcagtgtagaaatatgactggacaagaagagcctgagctaatgttaggagattgaacagaacaccaacaaggtctttctgtccagttcttcttggcctctctgggcagcttcgtttctcctgggtgtggggcagggtcctctctggaataggggtcttatgatccatagtccaacaaggtgggttggatagtttctttatggccagttcttatgcagaatggtgggataaatttcaagtaatatttttagctagttagttagttagtttgtttgtttttgagacagagtctcactctgtcacccaggctagagtgcaatggcaccatctccactcactgcaacctccaacctccgcctcccgggttcaagcgatttgcctgcctcagcctccctagtagctgggattacaggcgcccaccatcacgcccggctaatttttgtatttttagtagagacggggtttcaccatgttggccaggctagtctcgaactcctgaccacatgatccacccacctcggcctcccagagtgctgggattacaggcgggagccaccgcgcctggccatatattttcaggttttatggcgggctttggggagaaggagttctggtttctatgacccaccttgaggaaaagggattctagtttccctggctgggggaatggggctgagagagaggagggcctgggaaggtcagagaaaaacttttgttttggaggctgcttctgaggccttcattttggggtatggttttctgaaccccaacaatggacatgtcaaccacagagggcaggaagcagaggggaccgcacagagggccagaatctgaagatcctttgaggcgcctggtccacggtgtgcatgattttagtcatgggccttttctctaattacctccattcattcccttgggccagccctgaggggcactgagacagggctccagggagacgctgccgcccagctggggctgaggacgcagaggtgccacccgcacgccagcagcacacatcggacggttccctgtgtgtggtcttggattgactcttccacctgggatcggaaccctggaaagaaaaaccttctccatcccagctttaaccaaaagaaaggctttggcctccatgccagaggccctcccaggccagctcccccagccgtgcttacccccacacctccgctcccctcagagccagatttcttgaagggggtttgctctcctctgctctacacggtcacctctgctctgaaacaatttagctcttccctctgctgctgcccaattgcttaacttcctggtcaccaaccccatggcccttccggccccagcaccttcttgcgctttccatcagcttctagaaaactgcgcttctctgcatgcagagctttgccctctggatctcctacctctctaagggtctccctcgtctgccgctgcccccagtgtgggctttgccgggacctgtcttcagcctcccctccactgtggcctctcccctcaggaaggggctacgtggtgaggaccaacccctttccaccgatttccactcacttcgcccttccttaactaagccttaactaaggctcaatgccagtgtggttggccacggagctctgctgggatcaggggcagcagcattggccgttgtggaagtaggaagagcaagggtgggcttctgagctatggccggtggaagtcctggctctacccctcacctgctgtgggctgtggttacgataggcaaggctgctgtgcccgttcctcattgtgtaatgtggataataatcataaacacaggaacaccagtggtgcctattgcatgctggacagtgtttatttatttaattttgtttgtttgcttgtttgtttgttttgagactgagtctccttctgtcgcccaggtttgagtgcagtagcgccatcctggctcacttcccaggcctcgacttcccaggctcaagtgatcctcccacctaagcctcccaagtagctgggattacaggcgtgcaccaccatgcctggctaatttttttgaaattttcttgtaaagatggggtctccctatgttgcccaggctggtctcaatctcctgggctcaagggatcctcccacttcagcctcccgaagtgctgggattacaggcctgagcacactgcaccatgcctggacagtattctaaatgctttgcacctatgagttcacttcgtcctcacaaaaattcctatgtgatagatatattattgcccccatccccacccactgagctgcagcatctgaggcacagagaggcaaagtaacttgtccaaggtacacagctcacagatatcaaagctagaatttgaagccaagcaactctggccccaaaatctaaactgccttctagatttgaaatgaagattaactaaggctcaatgctaaatacttctccttctggccctgttttataacaataaagtcctcatgaaactgaaaccacctttgctatgcttctaacctccaagctgtccttgttcattctcgggtgtaggctgaactaactttaggagaaacttagtttatagtttaaacaaagaacagtaacagcctttccccaaagcagacctccttcttacctgaggactagattgcctttgtaggactaacattagccacaggattagaaattctagtttaggagtcatgcagctggaggctacaagattctgaccctccctaaactgctcctaagatcagtgcttgagatattttgcagatcctgcacttgatggatcagctggcaccacccagatcaataaactggctcatatgatctttcggaccccccacccagtaactgaatcagtgcaaaaagacacgactccctatgatttcatctctggtcaatcagctctcctggctcactggcttccccccacccaccaagttatccttaaaaactctgctccccaattgctctgggagactgatttgagtaataataaaactccagtctcccacacaaccggctccgcatgaatttctctttattgcaattcccctgtcttgatgaatcgactctgtctcacagcgggcaaggtgaaccccttgggcggttacaaaacccaaccaattttcaatatttgaggtcaaatattatgagctcaagccacgctttaggtgtccactgtgctctgcgtgtattatctagcagctgcgattcactgagggctaacacacgccatgcgttatgtacggaatttagattccgcatctctaatccaacaataacaaccctgaaggtagatttgaacgtttccccattttacagatgaggaaactgaagccgaaagagctttcgtgagaagctgggccaagattcaatttcaggtatctgtggcttcaaggcctgaggcctttccttcccggggtctcctgcctccacggagatggctctccttgttggttcctgtgtctgacttcagactctaaaccctttgggatcactcctgtttgtatccccaggctccagcacagtgttaggcaggtgacagacaggtgacagaacttgttgtttgttgggtaagtgggtaagcagtgagtgaatgaatgggctaagccctgggcccttctgtccaagagcgcagaaaaggccccctgcccagaaacgttgctcctgctggccccaggaccagggcacatcctgctacaaagagctgcagagctgtcctttatccagaatgtggtgccccctccccaagccctctgccaccctggcccccaggtctgttctctgtggagtggccattccacactcaccagttacaggatgggccttctcgtgagtcctgctctcgctcacagaaggaactggctctgtgccccttggccccgaagaccagggcctgtctgcagaagcagtaagtccatgagcagtgcaggaacaggcggtcccagcccccagaggcaagaggccaccctgcccgcaggccagggcgctctggaatgagccacgcactgctgaacagtcaccatccgcaaatgcctgtggacatttcccccagtgtggggttggggcctctacctcccactgttcctccttctcctgggatgtttttgggtaatggtaccatcatcctcctagtcaccccagcgtgtgtgctcagagtcaccatgtccgctatgtgccatcaatcactgggtgctgcagagtccttctgactagcttggtctggcacccaagcccaggcccctctgtctctcctcagccaagaatgggacttcctctgtccctgagccctctcaggtgccctgtgctcctgcctggccggccaccctctctctcttccccaaaaagcctcgccctctgtctttgccttggcgttgctgttcctcagaattcagcacagccccaccaaccactcccgagtcccccggattcactccccactccccactccccacctccttgtttccctcctccttctccctttccccaggagggaaattgaagacagttaaaaatagaacaaatcgaagtgcaccggccaaagccaagcaccactcagcaggaagcacctgaggctcggttccccctgctggaaggcgccccaggcaggcctcaccctcccctccctgctgcctcctccgtatgttcaaatcctgccagacttgcacccagctgggagagatgatgttcagaccgcaggctgctggcggtgcatggggggccaggggctcgggcactcatggatttcagagcagttctgcccaggctcgctggccgccgccaccttgctgtgctcctgaagcaggtcagagcccacccccagggcccttctgtgagccctgggctggaagataatggcaggggagggaggccggagcaggcggctagggttgcagataaaaggcagacacccaggcccagttaaataaatttctgagcaattacaattatttgctagtacaagtatatcccggcaatatttgggatatatttatgctaaaaaagttaatttgttgttgatctgaaattcaaattttaccagatgtcttgttttgttttcttctgttttctttgcctacataggtgctcagtcaggctaccctgggtagtcccaggggcaaccctgccaggcctgttccccatccaggcccggcactccagcagagtggaggcaaagagaagtgggtgggagggagtattcatttcctagggctgccttaacaaagtgacacaaactggagagggggtggaggtaaaaacaacagaaagttgtctcacgttctggaggctggagtctgaaatcaaggcgcgggcagggccttgcgctctctgacggctccggggggaggaagctgccttgcctcttgcagcttccggcggtggccagtgtgccgtggcttatagatgtcactccactctcggcctcagttggcataaggcatcgtctcctgcgtgtccctgggtctctgtttcctctgcttctaaggacaccagtcattagatgagggcccaccctaatccagaatgatcccatctgtgtctgcaaagaccttatttccaagtaagagtgccttctcaggtttcagggagacacgaatctggggggactcttcaacacaggagagagaactaagtctgacttcattctgcattcacgcacacccacctcactgaaaactttcagatccaggtgaccataaaactgaccagaaaaaaaaaaaaaaatcaaatatctgctccagaagtccttaaaggccaaacccatgcaactccagggcggcaggagctggcactcagtgacacctcgggcctgagtgaggaggctggaacttgcctccacctgcttcttgcaaagaacctttcagaaggggcacccaccccaccccagacactagcaaaatggtgccagcatcactacaagaaagctctggaggcagtgtgtgtgttcttggggccattagtcaagtctgtgcagggcggaggttctgtgagaggctgagttcctgcggagggaaaggaagagctgtgcccaggcctgctgagaggctgcacaggccaggcgcccccacgccctcccaggcccagagtccatttcagccatgtgcctggagcctggctgagggagggagtgccaggctgatgaaagtgagaaggctcagcccggcgcagtggcccatgcctgtaatcccagcactttgggaagctgagatgggaggatcacctgaggtcaggcgttcgagaccagcctgaccaacatggagaaaccccgtctctactaaaaatacaaaaaaattagctgggggtggtggtgggttcctgtaatcccagctactcgggaggctgaggcaggagaatcgcttgaacctgggaggtggaggttgcagtgagcagagatggcgccattgcactccagcctgggcaacaagagcgagactccgtctaaaaaaaaaaaaaaaacgaaagagaaggctcaggtaagggattgagcactggcttctgacagcctcagaggagcagaggggttgggagctgctgctccctggagagcctcttggaatcccactgagctcccagatcccagactctgcccccaccagcaatacggcccagccctgcagtaggcatatctgttggggcccaaagtgtgttgtgaaaatgcacagtgcctgcagagcggacacacaggctgggctccttcccttgttttctggagcccctctgggtggagaagccctcgtttcagctacctcataattaataatgacataatggagtgcactgtcggggcagccaaaggaatagtaacgcagtggagagcagtccatgatttaatgcactgaaaccaacagcctcggcccccagcacacacacgcaggctgggcagctccttctcaggggcccgcactgcctccttctccttggcaggtgtcttcttggggtcacacattggaacagccctgtctacagccttgcttgctgcccctgcggtgtggagacagcatcactcttgcccaggacgcctggctgcctctcaggggtgagggggtgagaccttgattttgtgggcctatagcagcctctttctagtcagataaaggctcaaaacctccttcctaccttcctcccttcctcccggcctgaggcagtcaccctcatagccctgtagagtcttcagagaagtggcaattcaaaggctgaatgctccattatgtggctccggcaaatggcttgtctcccgtggagagatacagaggagtgggtctttgacaggctggagatgctctgatccgcccgcggtgctgtggagcacgccggtgccttgcgtgtgttctggcccagagcctactgggccacgatttgtgtatcttttgtaaagtgccatgcgtgagccggatcggccctgacataattactggaatattttaatatgaagaagagtctctgagtcatctgctcacacacctccaccggggccccatcttagccaggacactggtcagagacagattgtcttcctctgatggggaagtgacaactcagcctccccagagggagggctgagcacagagagacacctgcaaggagagaagcagcttcagggaaccgcccagaaaataaagggctcttgggatcctgcagctcccattctcaggccagagggagcagtgcaacaaagggggccggcctctgctgacatcagcgagaccccaaataacaggaccctagaaagaagctttgtcagaccaaatctggggaggcagaggggaggaggaaggaaagccctcgggaagccacgctctcactcctctccatggggctctgggatggagacgtgagaaaaaggtaactgaagtctgagttgacaaagcctgagacagaggaaatgtacagttgtaatgaaataaagcttacagtcaacttcatctgacacacatagaatgataggcagaatctttactgtgctgttgcctctcagtcctaaatgaccatcggttcactcacataaccgcagttagtgtgcctctcacaggggcacactctgcacttctggggtctgtggaggcgagcccagtcctgccgcacagctgctgttctccagatcctcgaggccgaggcccttccactctctggggagaggatgccccagcatggaaacgaaaaggtaagtaaactgtgctggcttctctttcaggatgtttctttctttctttctttcttttcttttttgagatagagtttcgctcttgttgcccaggctggagtgcaatggcacgatctcagctcaccaaaacatctgcctaggttcaagagattctcctgcctcagcctcccgattacaggcacgcgccaccacacctggctaatttttgtatttttagtagaaacggggtttctccatgttggtcaggctgatctcaaactcccaacctcaggtgatccgcccgcctaagcctcccaaagtgctcagattacaggcgtgagccaccatgcccggccaggatgtttgttaatagtaagccagaaaatgaaatttaagggaaggccatctatgcatgaatcaaagtccccatggcccccaggaaagccacgtcatcagcttgcctttctagcacctcacaccgaggcaagaatggctggaggtgacccccaaccctccagcctcccccagcactatttatttgtcagtacaaatggggaagaattgcagcttgtgtgttacaggaaagatgtggtagaaatgatttcataactcgcctttaaaaaatcgactctcttttaaaatctatgatagccagaaggagacagtccaacagcagaggaaaatttcaaagtaaagctgttcttagattcctcctccccagcattcagatcttctccaacttccggcatcttctttcttctgcctctcaggagtccagagcttctgtgttgcccactgtccagacccccctctctggctttcacctgccctttgcctcctgcacagagccctatgatccctaataactttctctttccctccctttctcaaagctccctttcttctaaaagtgatcctgagctaggaagtctcccaatattttacttttctatagtgataataaagaaagaaaagaagaaaagtgtcacagtggaaaagaccaagcagatcaagaggaataaaagacaaaccacagactgggagaaaatatttgcagaagatatacacgacaaaggactcttgtctaaaatatacaaagaactcttaaaactcaacacaaacaaaataaacaatttgattaaaactgagccaagactttaacagacaccttaccaaagacatacagatggcaaagaagcataagaaaagatgccccacattttaagtcatcagggaaatgcaaattaaaacaacaactactacacacctagtagaatggcccaaatccagaatactgataacaccaaatgctggcaaggatgtggagcaacaggaattctcgttcattgctggtgggaacgcaaaatggcacagtcttgttggaaggcagtttggcagtttcttgcaaagctaaatgtactcttagcatatgatccagcaattgtgctccttggtatccatacacagacctgtccatgggtgttcatagcagctttgttcataattgcccaaactgggagcaaccaagatgtcctgcagtaggtgaatggattaataaactgtggcacattcaggtaatgtactattatttagctttaagatgaaatgaagccaggcgtggtggcaggcacctgtagtcccagctactcgggaggctgaggcaggaggactgcttgaggtcaggagtatatgactaagtgaaataaggcagtatgaaaagattacatactacatgattccaactatgtgacattctggaaaaggcacaactatagagagtaaaaatctcagtggttaccaaggttaggtatgaaggggggaaggatgaacaggtggaatgcaaaggaattttagggcagtgaaactgttctgtatgatactgtaattgtggatctatgtcatgatacatttgcccaaacccatagaatgtacaacaccaagagtgaaccctaatgtcaaaaatattttctttgggtgacaatgacatgtcagtgaaggttcatgaattgtaatgaattcatgctctggtggggggtattgataacgggggttgctatgcatatatgggggcagggaggatatgagaaatctctctaccttctcggttttactgtgaatcgaaagctgctctaaaaatacagcctaaaacaaagagagggtctgcacagctccatttccttgttttcctcttctccttttttgctcttactctcatctttttttttttttttttttttttaatgtgagaaacataaacactctttgggaagtaaatttttctcatctttagaactagccctggcaccttcactagagcatttggattactttcccacccaacctctggacaaaatcctccttctcctctccccctcttctcctctcccctccttctcctctcccttccttctcctctcccctccttctcccctcccctccttctcctctccccccttctcctctcccctccttctcctctccccccttctcctctcccctccttctcctctccccccttttcctctcccctccttctcctctcccctccttctcctctcccctccttctcctctcccctccttctcctctcccctccttctcctctccccccttctcctctcccctccttctcctctccccccttctcctctcccctccttctcctctccccccttctcctctcccctccttctcctctccccccttctcctctcccctccttctcctctccccccttctcctctcccctccttctcctctccccccttctcctctcccctccttctcctctcccctccttctcctctccccccttctcctctcccctccttctcctctccccccttctcctctcccctccttctcctctcccctccttctcctctcccttccttctcctctcccttccttctcccctcccctccttctcctctcccttccttctcctctcccctccttctgtatgatgttctgtatcatacagaacagtttcactgccctaagtgactatgcaagactatgtgtaccttgtctctctctgaacctcttacctgcatcctacaaccactgttgtcatcctccacacacattatacctcctactgaccttcagacaggtaaccctgctgtcatccacttccattgacaagagtcaaaagtccagcagtatccaggcagttctttcaacagaaggaatttaacgtaggcaattggttacaaaggtgatgaagggctgacagaaaaaaaggggaccagggacactgataataatgaacaggaagcagctattacccccagtgctaggggagcaatgggaagggactggatgtatcaagagatggaattttggagaagggaccccccagggcagagacgttgcccagctgctgctggctgggacctctagggaggcatggtgaggctggttctgggagcttaaacagaagctggcagctggaacaagctgctgttgtgcccaggacaggacaaaatgctgctgttagagcagcaagaactggaacaataaccaaacagagaacagaaagtctcctctcccctcctccttctcctctcccctccttcgcctctccccctcctcctctcccctcctccttctcctctcccctcccctccttctcctctcccctcccctccttctcctctcccctcctctccttctcctctcccctcccctcctcctctcccctcctccttctcctctcccctcctccttctcctctcccctcctccttctctctcccctccttctcctctcccctcctccttctcctctcccctccttggcctctcccccgctcctcctctcccctcctccttctcctctcccctcccctccttctcctctcccctcccctccttctcctctcccctcccctcctcctctcccctcctccttcccctctcccctcctccttctcctctcccctcctccttctcctctcccctccttctcctctcccctcctccttctcctctcccctcccctccttctcctctcccctcccctccttctcctctcccctcccctccttctcctctcccctcccctcccctccttctcctctcccctcccctcctcctctcccctcctccttctcctctcccctcctccttctcctctcccctcctccttctcctctcccctccttctcctctcccctcctccttctcctctcccctcccctccttctcctctcccctcccctccttctcctctcccctcccctccttctcctctcccctcccctcccctccttctcctctcccctcccctcctcctctcccctcctccttctcctctcccctcctccttctcctctcccctcctccttctcctctcccctcctcccttctcctctcccctcctccttctcctctcccctcctccttctcctctcccctcctccttctcccctcccctcctccttctcctctcccctccttctcctctcccctcctccttctcctctcccctcccctccttctcccctcctccttctcctctcccctcctccttctcctctcccctcctccttctcctctcccctccttggcctctccccccctcctcctctcccctcctccttctcctctcccctcccctccttctcctctcccctcccctccttctcctctcccctcccctccttctctcccctcccctcctcctctcccctcctccttctcctctcccctcctccttctcctctcccctcctccttctcctctcccctcctccttctcctctcccctccttctcctctcccctcctccttctcctctcccctcccctccttctcctctcccctcccctccttctcctctcccctcccctccttctcctctcccctcccctcccctccttctcctctcccctcccctcctcctctcccctcctccttctcctctcccctcctccttctcctctcccctcctccttctcctctcccctcctccttctcctctcccctcctccttctcctctcccctcctcccttctcctctcccctcctccttctcctctcccctcctccttctcctctcccctcctccttctcctctcccctcctccttctcctctcccctcctccttctcctctcccctcctccttctcctttcccctccttcttctcccctcccctccttcttctcccctcccctccttctcctctcctgtcccccagtgtgctctaatggctaagagtcagctgccaaaggagaaatgccctttgcagagtcccagacgtggcgagaacaggagaatggcgttaggggtgagagaggtgagtgaccggaggatgcacttgctcacaatgactctcaattccaagatgtggcaccgttgacaagatagcacagtgcatccttctgccataagcttgcaaaacacaatcagagcaaaaagctaattaataagaaccacgtatttcaagtcaaatctatagattgagaccatcgcaaaaattctggggtttttcgatggcttccgtgaacatctctgctcactggggtgttgggaatttggataaggcagggagatcacccgcctgcagaatccaggcttcctctgagaggctgctggctgtgcccagagatgtcttggccacgaacccctcagtcactgccagcgggttctgcacgcgccttggagtcccgggcatccactgacatttcttcccccggccccaccaccaccttgtctctattcctcttcgctgcggttcatttctcccagggccccatgcacttgtcctcggaccctcgggcggaaactgggccagcgcttcccctggtggcagtcagtgaaagtcctcagattaccttcatcggagggaaatgataatcgtgtttattctgaacttcacctcggaccaggccctgtactaagccccctgtttggatgccctgtttggagacactttcaccttcatgagggcttctagtccggcgctggccagtgccagcggttaggagcgtctcccctgcactggccaaacacgtgcctgtaacttccagcctccacccctcatttcgctccctagggccacgtggactaaacctaatccctctcccacaaatgtctgcatcatcccatctgtccactaccacctgcaccagccaccgtcccaccaagtctgcccttgcccagtcgctctcctctagagacctacccattcagaagggccatccatttccgttaaacttggcctagtgacctaagagtggtgggaacagagcaaggccatcagcctcctgctctgaatgccacactttaagtgcacctgaagatgttcaaatatcagtcactgacggtgaatggatagtgccaagagacctgtggccttccactagagacccctctgatccatgaggcagtattcacttatttacccaggtaactgtctgcatcagcgtgccatcttccaggtcactttcttcaccttctgcataatacttggcccaaagccttttgctgaaatccagattttcattcattcgctcatgcattcatctatgcaacacagacacaccaagctcccgctatgtgctgggcacttctgtaagtgctggagagacccaactgaacaggatggatgccgttccttcccttatggagttcatataatgggggggacagggaatagtcaataaacacattaattagtgagaaaatattaatgagataattttagacagcgctttgaagaaaataacaactgagattgtagcaggggcaagtgtgaaaataggagaccaattaggaaagcttaagttaggctgggtgcagtagctcatgcctgtagctctttgaggccaaagcaggaggatttcttgaggccaggagtttgagaccagcctgggcaacatagtgagacccccgtctctacaaacaacaacaacaatgaaaataaataaataagcacatgaaaggaggctcaagtgagaactcagaaatgccaggtctaccacatcctctcctctactaagcagggaactcccccaaatgcaggggtatctggctaaatttgtctttgttaaccccatgctgaccttcatcagtccctgcgtcccttcctgatcctcagctgaggtgttctagtagctcccgaggaccaacacaatttccaccagctgtctcactttcctctcccgtccccacaggccctcacggactgccagcagctgcacatccttcagcaattctcaccggctgtctcactctcctgtcccgtccccacaggccctcgcggactgccagcagctgcacatccttcagcaattctcactgctgcctcactgtcctgtcccgtcctcacaggccctcacagactgccagcagctgcacatccttcagggcttcaggatgtcaccccagccacagccctggcccctcaggaggcaagagcacgttgagagctgtcaaagctcttaacctcctcccctatcttggtgctccttccacctttttctgcctgaaggttcttctagagagaaagctcatgtggacaggcccctgcactccactccaggggcatcctcatagccatgctcctgctcctgacacgccccatcttgcttaacttctaacaccccttggagtggtttccaaggcctttggagtacttcagctcactcgtcttctgacaggcctcctgcaagcccagcttccagtgggcaatggcctttgagaagacacccactttcctgcattaggaaatgtcctttgtccacctgagctgctcagagcacccctgtgcaactctcctggcttctacagacacctcctccctcctctttccatcctccttggtgaaggaccctgcttccttctgagaaccgcccatccctcttgtgcagaacctagattaaggctaaaaattctaagccaaaacacacagcaatcaagagagatacaattttaacacaatcatgttttaaaaatctaaatttatgcaaaaaatccttgaataaaatatcaagactttaactacagacaggattggtattactagtttttccttttgccttagattccaatacgacccagtatagcctttttgtttcattgtcgtgaaatatacataatgtaaaatttaccattttaaccatctctaagcgtccaattccatgtcgtgatgtgcgtttccattgctgtgcagccatcaccactgtcttctgcacagcttttgtgtgtcttccctctcacggaatcctttctgctttcgtgatccttcctcaagccaagcacgcccttcttgccgactcccaggacctctcaaatcagacgctagatttctcccaggtgttccatcctatccacttcactcctcactggtgagaaatgggctcagggtagcagctcccattgtcagttctgggcccttctgagaaggggtgacatcagcccgcatgaatctcacagccgcggtctgcaaagatggggtccctatctccactgggtctgccctggtgccaggtctgaacaacacatcagcaatgttccatcgtggcccgcagcgtggggaaaagccccacctgaagcccaaagagcaaagtccgtgccatttccttggttagctgctgagaaggttttttttttttttttttttttttcagacggagttttgctcctgtggcccaggctggagtgcagtggcgcaatctcagctctccgcaacctccacttcctgggttcaagccattctcctgccttagcctctcgggtagctgggattacaggcatgtgccaccacgcccagctaattttgtatttcctaggagagacaggttttctccacgttggtcaggctggcctcggactcccgacctcaggtgatccgctcgcctcagcttcccaaagtgctgggattacaggtgtgagccaccgtgcccggccaggaaggcttttttaacaacaagtacttaagaaaagaaaaagaaaaagtgttaggtatagttgacttgttcctctgattaaaaataagaacagggctttgttcattctccaaggtggccactttgggaatccaccataaagtgattagtgagacaattacagctgtgaccgaacacaacaaaattggtgcttcaacttcagtgtaatgagagcttttcccttactttgctatttattgatttggtgtaccctccctcctaccttaatgattcatagtttaaacttgtctacacgatttatatagaggcttggagacccctattattcagctgcggctctcaagcaacacccacgggaccgagtccttcgcctctccccagccttcccaccatgagctgctgaagacggaggacctgccaacggcctccgaacaggaggaagccaggaagcagccagtgggagaaattacctcctgaggccagaagcaggagactagtaagtcagcgcacccccaggcttgaggcaaaaatgaggctcccaccctatttgtctttgcaaatcacttcacctcactgtgcttcagcccactcctaggacacagggcttcagccactacccaagactgccttggggggaacaatattaataactatgactgtgagtctcttttcctgtgcacttattaccagtgctgtatgagtgcttattattaataataataatttagtgccgactttactgcttttgtgtaacagcgagtacctggattctaattatctgtcttattttaatatttatggaattaatcaaaactttgtaatggaaaaccccacgatgaaattactaagagcgtatgcttcaatgaagacagatgcagcacactgtaggaaaagacagctccacttcatagcgttaccgggaacagctcagggtgctggctggcccctgagccaggcagggtggtagagcacatcctggagccccaaggcagggcctgtggcatcccagggagcggcccatctgtggtccccccaaaaaaggggtctccacagcccagctgccacctatgctcacaacaggggtcgggggttcgtctactcatcaaggctaaactgtgcgctggccaggccctgtgctgacaggtgctccgggctggtcccatcaccccagagacaggcagcaaagccaggtccaagctctgtctaaagatcaaggaagaagctccctctacaaagagctctggagctcagcaacttgtacccagtcatcgctttagaaccttcgctggtgtcagcgaggtcagaaatgccatccttggcattatttccaacctggaggatccgcatcctgggctgagctggtcagctgatggtcacccagcaccccactaagatcctgcagctcccagggcactaggccagagtgtagggcggggacaaatgcctctcaggaaacatcccagctcccactgactgagtgctgacagctgtctggccctgtgggagatgctttctgtgtgctcctgaatttcagttttatgacaaccctgtggatcaggtactgttattcctttcatttcacagatgagaaaactgaggctaaagaggtgaagctgcttgctcaaggtcacagaaaatgctataccgaatggcctggggtttgaactggggccaggccacgtccatgcctctgctctgagccagggccctccactgcctcccatctccttttctgaacacctctctctacaactccttgatcgggggcctgagaccctgggactaccgtgcgacttccaagggcttacattcttggaatcacagaggtccttttctagcccgattttttgccttcctctgcatgcctcacccccaaacatcttcaggacacagccagggctaaacgggacatgataagatcacctggggagcctgagaaatcctgatgccgagggtgcatccccacgcatgcgtcatacgccctgggacccaggcatgggtaatccctattacagtaggaggtttggtgagaacatccatataaagcatttagaagatatgattccaccatgtgcccgggattccactgggcttcttaatcccagcttctcaccagaatcacccagggagctttcagaaatacccaggtgtaagcctaaccgccagtgattctgtttaattggtctgagaattactgcatatagtttttgagcttcccagttgattttagtctgtcgtctgtatggagatgtcctggtttaggatgaaaactaattgtctgaaaataaatttactctaggactgggtgtggtggctcacgcccgtaatcccagcactttgggaggccgaggtgcgcggattacttgagaccgggagttcaagaacagccaggccaacatggtgaaactctgtctctactaaaaatatatattaaaagaaacaaagaaagaaatttaccctaagaagtgaatactactcttcccggggctgacgtcctattgtctttgtatgtgagttcaaaagtcacctattcagagggacaccccctgacccccacctcactcccccagcaacagtaactccacccccactctctggcactttatctagttttcttgttctcatagcgtattttgctgtactatgttaaataaagttcccctaaaatttatgtccacccagaacctgggaattcgaccttatttggaaataacttaacatgaggtgtaatcaacttaacaggaagtcataggggattagggtgggccttaaagccaatatcactcagaagaagaaaacgcgagctgcgtagttccagctacttggaaggctgtggtgggaggattgcttggcccgggaggttgaggctgccgtgctctgatggtgcctctgcactccagcctggatgacagagagagaccttgtctctaaaaatagaaataaaaaacagaagaggaaaatctggacacagagacacccagggagagcgccaggtgaaggaggctgagattggggtgatgcatccacaagctgaggactgctggcaactagcaactagcagaagctggaagagacccggaaggcccttcccttgctcctccagagggagcagggccctgccaacaccttgactgcagaccgccagcctagcactgtgagagaacggatttctgttgctttgtttttgtttgagaccgagtttcgctcttattgctcacactggagtgcaatggcacgaccttggctcactgcaacctctgccccctggattcaagtgattctcctgcctcagcctcccaagtagctgggattacaggcactggccaccacgcctgcctaatgtttttgtttttagtagagacgggggtttcaccacgttggccaggctggcctcgaactccagacctcaggtgatccaccctcctcggcctcccaaagtgctgggattacaggcatgagacaccgcgtctggccagatttctgttgttttaagttacggtgtgtgatcacttgttaaaacagccataggaaactaatgcatttaccttgggaaatgatgggatttattcctttgtctgcttacctgttgcccggctccctgacggcacatgagcaacgatggaagggcccgtctgctcactgctccgcctccacacctaaaacagtgtctggctcatagtaggcctcaaaacttttgcttgaatggataaataaataaaaagcatcactcatctaggacagacaagtgagctctgctcagtttgtgcaggacagaaagggatgtactttaatttagcacttattgcaaaggggatcattgttctaaatattttatctgtccgttatcattcagccatttactaagtgtgtgaagtagatgcactgattatccccattttatgatgaagtaactcaggttcagaggtgacgtcagcagctggagtgcagacgtcacagaagtggtaaagcgaggaatcgaacccagggccatctgactcgagaaaccccatgctttctgcaggggcggcctggccggccctcgcctgctcgaatgccaccaaggatgcaccccagagggcaggccaaggcagccaggacctcacttggcaaggtgctcaaacctggccttaacaaacaaacgtttctccaaattcctgtcctctcaagcatttttctttatctcccttacaatcactcctggaatttgagctggacccctaatttatcaagggctctggagccttctggaagaccgcctaaagaggacaagtccaaattagaaatgtttatcttgtttctaaacgtgatactttctcgtctcagcttttcctaggaagcactttgttaaggaacggagaagttgggcaaaactaacctgcactcacatcccaggtgagggaggagagcctgacccgtctttattttaaaaatgattgagcaagttgtatccccgggtaaagtgagtaaatctgattctggctgatcctttcgcagggctctttggactgcaggagaatctggatttgccaagcccaggaagtgcttattctctttatggtgatgactgagcacgctgtgaacctgagcgttctgtgcactgccttcaccacgtctctaaattattctgacatcttcctcctcttctcctctgctggaacctagctttaattatttttcagtaacaagtcaattgtcccgtttttcctttcccttcaaaacgtgttcatcaccagagccacattagtcaaaagtgacagttacaaactgaaatcaatgtccacatcaccaaagacatcagagataccaaaggccggttaggtcagccagcgcacgccaggcgacaacgtgctcgtgggtcacagcagagccgtgctcctctctggccccgtctcccacccctccgctcctgcaaggctgccactgaccaggaatcagcaaccaacctcatccagctcttttgtcctttcattaagtaaccactgagaaatgagtaaaggaggaaggaatacagggagaagaaaaaaagagcaggtaacgtggaaaagacaaggggaagagagtgaacaggggaacgcagagggcgtgagggaagaaagagagattctgctgcgagtgccagccttgggaacatcccttcttagtgaagttaaggaatgcccatttgcatccccaggaaataagaattaaagaggaaaagggggtcgtgcggtggctcatgcctgtaatctcagcactttggaggctgaggtgggatgatcccttgagcccaggagtttgagactaggctgggcaacattatgagacccccatcccaaaaaaaaataggaaagaaaattcagccaggtgtggtggtacacacttgtaggcccactactcaggaggctgaggcaggaggattgcttgagcccacaaggtcacgactgtagtgaagtgtaattgcgccactgcacttcagcctaggtgacagagtgagaccctgtctccaaaaaatgaaagaggaaaagggaagtgtggggagtggagaaataaatgaagaccaaagcaacgagaacagccagaggctatttattcagagcttgccatagcaatggagtcagccaccatcacttacgttctggcagagactcaaaggcaggcagggacatggaaaagcttcagagtggaaaaaagggaaggcgtcaggcgtggcctgatggaggctgtggcctggggaagctgcaggcgggctggctagaggcaggcatcctatgtggttagttaagcgggtatatttggctttctctggttggaagcagggataaaaattaggcgagctgtcagttattagtcaagtcctggccatttaggcagattgttatggggtagtggtctgtgcgcagcctggtgccctcccagcctgattggaagcactggcttcctggactgactgttggagacaatgggtttgctccttgcttgcagacaatgggtttgcaggttgctgcaggctgtgggtcagaatctgtttgcacacatggttgggcattgtctgttcccacattcagtctcttaacaggtcatcattgccatttttgtgctcttgacttatcttattttctccaacctgagttccagagctccctcctgagttccagaccctgggactgattggctcctgggtccagacaatttcaacaccccatcaattttacctcccaaatacctctccaatcaagcatttctgtccacccgcaccagccaatccaaaatcccctccccccaccgtccccgttggacctcagacacgtttccatgtgatctacttgctgtcaaccttgacattctctctggtttggaggagtccaactccaggaccaaatcccatgcgtggtcttccagcccaactgcaggcaattgcagtggctccacctgagaggcttcagggagggcagggggctgccctccccacctcagatgtggcactaagcctcactgcagcctggaggggttgcggtcaaggactcaccgcccctgcccactcagccagaccctacaggaatcttttcccggctggcgcctccattcagaggccaccttatgtggactggggctgggatcctgtccagcacctctgctgagacctcctctcaggaccgtccaagacacttcccactccagcccagggctccccacatctccactcctagccctttccctccctccctgggtccccacatccataaaatgtcgagtctttgctgacactccctgggcagtgaaaggggccaccccagctgactcccccagtccctctggccctagcctggcgctgttctggatgggcaggaacggaatactgggtgcaccggcctggcgctgttctggatgggcaggaacggaatactgggtgcaccggcctggcctccctctggtcttttgcttacactcccagtaagtgaataaataaagaactgctactgacagcttgaccccggcagcgctctaacaatttcaagatcagacatgcagtcctttcccttcctgaagtccttttctggcttcccactgtccgcagagactgtatttctttttctttcttttcttttctttcttttttttttttttttttttttgagacagagcaaggctggaatgaaacggcatgatctcagctcactgcagcctccacctcctggattgtaaagattctcttgcctcagccccccaagtagctgggactacaggcgcatgccaccacacctggctatttttttgtatttttttaatagagacggggtttcatcagctggccaggctggtcttgaactcctgatcacaggtgatccgctcgcctcagccccccaaagtgctggaattacaggtgtgacagggagtctatttcctagggctgccctaacacagagctgcaccctgggtggcttggaaacagtagaaatgagccgtctctcagccctggaggtgcagagttggaaatccaggtgtcagcagggccacgcctccttagaaagctgtaggacaagcgcccttccttgcctcttccagctcctggcagcccagacctttcttggctggtggcatcatcaccccagtcttcatagggccatcttcccactgtgactctttccaaagcctccacttttctgtgtccaaacttccccctttttataaggactttagtaacattggattaaggcccaccctaataatcacttgattacatctgcaaagactctatttcctaataaattcatattctggggtacagggagtcaagacatagcatgtctgtctggggggacacgagtcggtccgccacagggagcttccagatcctcaccacgggctggcaagtccctccccagcctggcccgccaccctctccacctcattcagggactcttccattcaccctgcacactccagacgcttcaactctttggagtccctcaacttcttattttatcaacaccagcttttgcggactgagcttccctaaatccaaaaatccaaaatccgaaatccaaaaatgctccccaatccaaatcttgtgtgctcaatggagcttttcagattttcatatgttccacaggtaagtgtaacacaaagatctcgaaatccaaaatctggaacacttctggtcccaagcatttcagataagggccactcagcctgtctaagcagcagggtgacaagaccctgtccaggagctgaggaaagatcccccaaaggagagccgtgggaagtgaggagggggttccagatatttccctaaatgtcctccatggaggctaaatctgttcttggcctcttcggaattagcgttctttccaccagtgagggcgacttatcatcatgccagcctgtcctgcccacagatccccttgtcacctgctccacagaccagcacaccccatggcctgctctttcctcccagccctctgacacagtttcctgatttcaagaaatggaaattatgttggttcgttcaacaaatatctgttaggcacagtgctggcgttggagtgcacataatttatgttaagacagatcagtaaaaacagtacagatcgtgtgtgtgtgtgtgtgtgtgtgtgtgtgtgtgtgtgtgtgagaattaactccaatccagtctctaggaaggggcagaggctccgtgttttagttaaatctgtaccacaggcttccttcattggtattggggtgttagcaattctctttcccttgtgaaactggtggtggtggccaagcgtgctggctcacgcttgtaatcccagcactttgggaggccgaggtgggcggatcacctgaggtctagagttcgagaccagcctggctaatggtgaaaccccgtttcacaaaaaattagccaggcgtgatggtacgcgcctgtaatcccaggtagtcaggaggctgggggaggagaatcacttgaacccgagaggtggaggttgcagtgagctgagatcatgccattgcattccagttgggcaacaacagcgaaactccgtctcaaaaaaaaaaaaaaagaaagaaagaaagaaaaaagaaagaaagaaaaagaaagaaaggaagaaattggtggtgttggagacacttggtggcctagaagcaagtcctctgctcttgcttgaacgggatgtggaagttgtaagcccctagactctcacctttgggagaaagacgtaggtctagaatcctgactgcatctgggtatacctctcctccctgccccagagccactcagcagagcatgtgttgcgggattcatttagaaggtaacttgatcctgctgtcagaatattctcacttgtgtctcacagagaatctttccagaagggcagagagcagaggggcttccccaagcccagaggtaaaaggcgtggatttgtgttgtgcctgctgcgacctgtacatttgtcagcaatcggctagagactagctttcatcatacacaccacctggcagggaggctgagtggggaaggcgaaattccccgccattgtcggaggctggcgatatcttccagactatggacaagttggcttaggtctgttcttaaccgcccagcaagaggtgaacaacaaagaaaaggttcctgatctcacagcttagagacgaaggacagacagctggaggaatttgctcaaaagaaattgcttacgtttcgccaaagctctaggtttttgcttggagacctcactggtccgaggctggccaagccggggactgcgtggcgttcagcactcctgcgcctccacagcctgggtgtgggcaaggacaggaggccgctgtggcactgccccttccaccccacgcccaggagctcagggaggaacctgccctggcttttccaagacagaagaggagattccaccatcaatgcaccagaggaaagggccatgaacgtggggagcccgggaggccccggccatgctttgcctgaagggtagggccgagggcgaggggttcccttcgtcacggtgtgctgagaacagatcgtcccagtgtttttgtttgtttggtttggtttggttttttgagacagggtctcactctgttgcccaggctggagtgcagaggtgcaatcacagctcactgcagcccagacctcctggactcaagtgatcctccagcctcagcctcctgagtagctgggaccacaggcacgggtcaccatgcccagttaagttttttgttttttttttttaagagatagggtctcactatgttgcccaggctggtcttgaacttctgggctcaagcaatcctcctgccctggcctcccaaagtgctgggattacaggcgtgagccactgcatctggccaccttccactatttgcttccatgctcattcagaattccccatggtaaaaatcctgtgaggaattatatcataaaatttaaaaatatattatttagtgatatttatagatttattctataatacattattatattctaagtaagaaaatacgatgttataataaacatattctatattatgtaataaatacattgtatataataatctatatattatacgataaatatatagataaaaataagataaaaatcaataaaccacatataaatagatctggctgggcccctctcatctttcctatctcagtcatttttctgggccccagacaccttcttcgggtctgtaaaagcccctccagcattcgtgcaatcgaggaaactcggaggagacttttggtctttagccccctggggttcagggaaactcatggacaagcccaagtcttgtggctcctctgctcccgagtcctgtcccccaggctcaagtcacccacaaagccttcccagaggctgccaaggccacgcgtagcacacagggtctctgttaccttcccgagggtaggagcagattcctgccatccccacagtcctgctggtgtccttctggcgcctctcccacaccctccctctccagacctgaggggcactctccacctccaagccttgacaggttagaatctcaacacccaaggccaaacatcactaaaacagtgacaatggggacagtcaccatggcctgctctgtggctgcaggtggtgactgtgacaaactggaacagacccatccctgctaaaagcatttgaatttacttcataaaaatcacagcaatatctaaatctttttgtttgtttctttgagacggagtctcgctctgtcacccaggctggagtgcaatgaatggcacgatctcggctcactgcaacctctgcctcctgggtttaagcgattctcctgcctcaacctcccatgtagctgggattacaggcccccatcaccacggccacctactttttgtatttttagtagagacggggtttcttcgccatgttggccaggctggtcttgaactcctgacctcaggtaatccgcccactctgggctcccagagtgctgggattacaggtatgagccactgtgctcggccagcaatatctaaatttgacatgcaggccatgagtttctagcctctggctcagataattttattttattttgtaaagacaggatctccctctgtcactcaggctgtagtgcagtggcatgatcgtagctcactgcagccttgaactcctgggctcaggcagctcaagcgatcctcccacctccgcctcctgagtagctgggactcgaggtgtgcaccaccatatctggttaagttttgtatcttttttttttttttgtagagacagggtctcactatgttgcccaggctggtctcgaactcctggtctcaagcagtcctcccacctcggcttcccaaagcactgggattataccacgcccagcccagacattgtaaaataatgttctgggtcattatcataaaaaggcagccaggtgaggacagagacacagaagagcaccatgtgaagatggaggatcgaggggtacatctgcaagctaaggagaatcaaagatggccagcaagccatgggaagccgggaagagacaaggacagattccccttcagatttcagaggaagcagggcccgccaacaccttgaatccagacttctagactgcacatctatgagacatgtctgttgttttaagccagtgtgatgatgatgatgatgatggtgatgatgatgtcctataactcttcttagggatactccagaattgaaggagggtaatggtctctctttctttcccatttgtgaggacgtgggcaagtaaatgagatacagttaatttttccatcagctctaaatttttgacaaatcactctgcctcagaggatgcaacagggacttgggtcagtcaccctggcttgctctgtgcgccaaccaagaatacaccaaaccggacccatctgtttgcagcttcactgagccacatcccacagccctgccaccctttaaaccagggggaatccaaaaagttctactgcccactgaggaggtgaggctttcctgccctcatttaacgtgaaatgcccgcgctttggcctctccgcctttgctgagagcagtctgtttcacggagaacagccttctgcaggaaaagccactgtcatcaggctctccgctacagtgtcatcatgattagggtgcatttaaaaagtaattaaaatgttgtgttgaacattaggactcgtgcagggccactgaggagaagccggtaattgggtccttggaaagctctagtcactttgctggcacactacagtgaaagggaacggggtggcgggcgggggcaagggcagggacagccaccactctcgagtctgtccctgcactccttgacggagagctcagctgatcagacgcccgcatatttccagatagatagtgctgctggggtgaattctctcttcctccactcccagattcatatgctgaagtcctaaccccccctccactcctcagagtgtgaccttatttggagattgctactgacccaagtggggtctgctcatctggcccagcaaggtcaatcagtggctttgggatcctggtgaaatgaagtgaggcacagattgcagtgcaccaagcaacactgaagacctgcactctccgatgcctggcaagtaagggttttcaaaggcaggggtacatttcaggaaagcagaagttacaggcaaaatcagaggctaacacatgatgtacattgctttggcctaaaaacgtggaacatctcaaagcaggggcccacagttcgattcaaatattttctgatttgcagttggttaaggaggcagagctttgtctacgtgtgctggagtcagcagaaagatatgttagggttgactcaagggcacgacctcctccgggcccctcaggaagaactttagaacaaagaatgccagtccgagttcagtcctcagctcccccttttgtgaggtctacaggccagtggatctgtttggtgggggtctgggtttctgaaaaacaactcaaggacttatgttaagatgttatctttaggtcaaacgcagtggctcacacctgtaaacccaacactttaggaggccaaggtgaaagtgtcagaggcgtttgaaccagagcaactccatcttgaataggggctgggtaaaatgaggctgagacctactgggctgcattcccaggaggttaggcattctaagtcacaggatgaaataggaggtcagcacaagatacaggtctcgaagaccttgctgataaaacaggttgcagtaaagaagccggctaaaacccaccaaaaccaagatggcaatgagagtgacctctggtcgtcctcactgctatacactctcaccagcgccgtgatggtttacaagtcatggcaacatcaggaagtcaccctacatggtctaaaagaacgagacctgaataatccacctcttacttagcacatcatcgagaaataaccttaaaaatgggcaccagcagccctcggggctgctctgcctatggagtagccattctttaattcctttacttgcttaataaactggctttcactttactctatggattcatctcgaattcttgtgtgaggtccaagaaccctctcttggggtctggatcaggtctcctttccagtaacaggaagattgcttgaggcgaggagtttgagaccagcctgggcaatgtagtgagactctgtctctgcaaaaataaaaataaataaataaataatttaaaaagatgttatctttggtttctgtagggaaccaaacatctcaggacgctaactcccttggctattgttttaagctactattaccttcttgtttatcaagctgctcatgtacttctcagggcgagctggatgcctggaatttccctagaaggaactcaagattttcctttattttcatgtttggttggggtgggggggaagtgcgtggcagccccctaagagaggtccctgctccatttccagatggggtcttcgcagaggtaatggagtgaaaatgaggttattaaggcagaccctaatccaatacaattggtgtcctttcaaaaagcagaaaattggacacaaacaggcatagagggaagacggtgtgaagagacacagagagaaggtgtctgtccacaagccaaggagagaggcctggagcagaccctcccctcgtagccctcagaagaagtcaacatagtggatacctggatttttggacgccagcttcagaactgagaggataaattcctgtcgtctgagcacccccgtctgtggtactttgttacggcagctggagcaaactagcctggctttccaggacccgtctccagggcctgctccccaccaaaatcccaggcaaataccatatttcactctgtgttcttcaaatactcacacacacacacacacacacacacacacacacacacacactcttaagtgatggtaacaatagaatatgatgtagtttcagccactcaagaggctgagtcaggaagattgcttgattccaggagttggaggctgcagtgaaccatgatcgtgccactgcactccagcctggacaacagagcaagaccctgtctctataaataaataatagaatatgactgaaaagggcagtggtgaaccagaggaagaaaggtactcgctaagaagtgaggatgcccactgcagccatacatcggttggaccttcagctgggttttactccacaaggtggagagcatggcagaaagacagggagacccagagcacccaaccctcttgccccatctggtccccaaatcaaagcctttataaaagcaacattggtgttatttaactctaaataatacatgggctggaatcaaagacatacaaaagtttaacattaccaagaagttgtcctgtctgcacgggagatgttatctgtactatttgatttctgtcccagcatcaaataaacatttttgtcccacaaatttatgggaagcagcttctctccctaatacgcagatgctaatgtactttctgccccaccagtgttttcagaaagcattcttagtctttgacaggtaggaaatttgcatttccattagtgaggcctttgtcaattgtgagttataaaagccccagaagaatagggttgggggaaatgcattgtattttaaaaggagactttattgcatggttcaacgaaaggtaccgaagtagataaagcctctggagcgggctgctgagaagcctcacaacgaggagaaacttgttaatgcacgtgcctgtcaccggacaaccagaggggaggaaagtctgaatgtgactttactagtttgcaatttactgtgtttaacattaaaatagtacactcttcgggggtgataaggcgcatttggtgctgccagtcaagtgcttctcgctcctgttccattagctgcggctgtaatcttctcatttaaaatcgctgctgttcggccgcagcggctctggcagggctgggggtttgatttgtgtatgtgatttgttttactctttatgttagtagagtcaagatgctcaagaaaaataaaagctcaagcatccccagcagcgaaaggaatgatgcaaacagcgctgcttcatttgttatcttatttgcccttcaaacttggtctccaaacacacagttaaataattcagtggccacactaaatactggagaggagcaggcagagagaaagccatcagaagtcatgggccagggaaacagcatttcctaagaagtaagtaaaccagagagaacgaggagtaagaggagcctcaaggtgacctctgtctgccctgcccaagactctgcccagtgcaaagcccatacagtggtgctggtcgaagctccttatctcagagatgaaggaagtgagtaaacacaggctggtgacaagcacaaggacacacaaatcattcgtggtgagcaagttctgaagtcccacatagtagcagtacaagccgcagacaaaaccccttagacacctagttaaagaaggaagggctttattcggccaggagcttcggcaagactcacgtctccaacaaccgagctccccaagtgagcaattcctgtcccttttaagggctcactactctaagggggtctgtgtgagagggttgtgatcgattgagcaagcagggggtacgagactgggggctgcatgcaccggtaattagaacggaacagaacaggacagggattttcacagtgcttttctatacaatgtctgtaatctatagataacataaccgattaggtcagggctcgatctttaactaccaggcccagggtgtggcacggggctgtctgcttgtggatttcatttctgccttttagtttttatttcttctctctttggaggcagaaattgggcataagacaatatgtggggtggtctcctcccttaacatgtcttggttcattgttcagggtttgtcctgtatattaggctgccttcactggacactttcctccttccctcattgcacagacacttattgagtgaccactgtatgcgaggcactgagcatgcaaaggagatgcggctggaccagatctgctgtcgtggaaggctccctgttttagtgggggagacaggcaatacacgaggaagccaatacatacacgtgataatgtcagcgctatgtgttgtcaagagaacaaaggtcatggggaagcgtggggacaggggccagtcaggagcaggcactgaggaggctctctggggcagcaggcagaggcatgcatgacaacaaagcgcgttccagactaccgcaacatcctgacagcctggccaagcttggtgtccccgcagcgggaggcctgaatgcaaggggagagtggccactgcagagcaagagtccaggtcctggggtcatggagaggagtggagtctgattccagctgcgatggaaaccagtgggagattttcagcaagaagcgacgtgattcaatttctgttttgcaacagcgcacacaggcattgagaatggattctggggtgtaaaagtggggagctcaatgttgcagctaggctgctggggtcctgcagggcaccccctccccggcccagacagcacctctctttcttgcctgagtttggaatcttttgagaataaacagtggagtggcaatggaggttaaaatagcatccacttcgatgataaggctcgggatgagaaccaaagactccctaacaacggccgcagaagcggacagtcctccatccccgaggagaggaagaggtgcccttggaggagcagcagagagcagcagctcctgcaggcagtgctcccaagggaggaaggacgggcaccgctgaacagacacatccagctcataatccccacatttttcatttgctcttgtcacccaggctggagtgtagtggtgcgatctcggctcactgcaacctccacctcccgggttcaaacgattctcctgcctcagcctcctgagtagctgggattacaggcgtgcaccactgcacatggctaattgttgtgtttttagtagagacagggttttaccatgttagtcaggctggtctcgaactcctgacctcgtgatccgcccgtctgggcctcccaaagtgctgggattacaggcatgagccaccgcacctggccaatctccacatttttcaaatagccagtcataaggtggaggggtaaaggggcagggaggggccaggagtaaagctaactgagcctcctctgctcgaaagggaacaggcacagaggagaggtattctgccccaggtgccggtgggttagcgcgagatgtttgtcatgaaaacggagagtatctcgagagaacatctgagaacttacagactcaaaaataggcactgtgttggccagtcccagctcctgcctctgtgtagcggacagcctcccctctccataagagatggttattaattaaaatgttaaccatcttcagggacacagcattcactcaccctttcaatcaagagttgaggctcgctttcacctctgctgtcctctgtggagttgaagggactcctgctctccttgtcataggttctcatccacctgagaataagcctgtattatacagttcttacatttccctttaacaagttaaacaacttccaactcctttgtaacctttgctcgtttctgcttttgattttctgcagttttactgtattgctcttaaaatgcaggcagcaaagcacggcacgccgccgcatcaccgggcctgacctccgctgcatgtgcacagcccgacggctgctccctggcgatgccatgtcctctcggttcagcgcggccacactcgctctctctgtcaatttcagagcagcgccagctctcacattctgctttaggcacccaataacccccaaggttttgtcttttgacaagagactgatttcaataactttctcctgataagaagaccactgagtgactatgaactagctctgtccagttgacagaggctgtgcgccgagtgctgtctccctccgggatctgcataaaacggcgtgcattcagtcctctaaagcatttatccatgttattactgaaagacgccttattattcatcaagcatttgtttaacttaactgggttacggtgacttctgttcctcctgtcttcggaacctggccaacatggaggcatttgcaggagcatgaagaaggggcctccccacttccttcagccttagagtgagcaccaaattgcaaacattttctgcttcgaggaagcaacgcgccagccagtgcccagcactcctgctctgctctgccttgggccaccgtttcccaaactggaggctctgggacattttgagagcgttgtcgataatgaagatgaggcagaagcttctccgaagcaggctgtacgatgaaggccagcaccagggtcacctgacctatcaccggtcggcccattgctccccaccaggcaatgctggcctcctccctgaactctaaaccctgcaagcgccctcctgcctctgggatcctatcctcactatggccctgtctagaatgctcttcctctttcttttgtaaactaaaaatgaaaccctaagctctctaaccaactgaaccttctcttggtcaagcagacccctgagaaaccttaaaaactgagtgccggcccgggcgcggtggctcacgactgtaatcccaccactttgggaagctgaggcgggtggatcacaaggtcaggagttcaagaccagcctgaccaacatggtgaaaccctgtccctactaaaaatacaaaaattagccaggcatggtggcgggcgcctgtaatcccagctactcgggaggctgaggcaggagaatggcgtgaacccgggaggcagagcttgcagtgacccaagatcacgccactatacttcagcctgggcgacacagcgagactccgtctcaaaacaaagcaaaacaaaacaaactaactaactaataaaacctgagttcctggccatgacaagaagggaagttaaacacacctcgctagactccctctttttcacactttagatacaactgaccagcatatgatagagatcataagactgacacaatggactctccatggcaataagataccaagttagaaacaagacctggccgtgccaggtaagggttaagtcatgcaactctacacttaaagaataaaccatactctgggccgggtgcagtggctcatgcctgtaatctcagcactttgggaggccgaggtgggaggatcacctgaggccaggagttcaagaccagactgaccaacgtggtgaaaccccatctctactaaaaatacaaaaattagctgggtgtggtggtgcacacctgtaatcccagctactcaggaggctgaggcaggagaatcgcttgaacttggaagtggaggttgcagtgagccgagatcgcgccattgtgttccagcctgggcatcaccatgagactctgtctcaaaaaaaaaaaaaagaacaaaaataaaccatgatctaactgccacaagctttttcttcttctctagcagctaaacaagcactggccttgagataagcaatgttgaagcaactgcagcttaccagccaccagatgctaactgagcccctgttccaccagccacgactacagctttgattggacaagagactgatttcaataactttctcctgataagaagaccaccaagtgactatgaactgttctgtccagttgacagaggctgtgcactgagtgccttcatgtcctaaaaagatctttggattcatagggcctaactgtaatacactgaaatgttacgtccccaccccaaggtgaacatgggttgtatgttacatgcatgtttgtttaatacacatgtgttgggaccaccttcatgaatattaatagctcctcctgtaatctgttgactaggtctgtttagccaacccattcagcataaatctcctaccccagctcctccaacctccaagtgcctgtctctggccttggccagaggctgtactttccagcctgcagaatggccttcttgcaggctataaccatttataagaaataaggtttccttttctggccaggcgcagtggctcacacctgtaatcccagcacctggggaatccgaggtgggcgaatcacttgaggccaggaagttgagaccagcctgaccaaaatgttgaaaccctatctctcctaaaaatacaagttagtggggtgtggtaatgtacacctgtaatcccagctactcaggaggctgaggcagaagaattgcttgagcctggggtggaggttgcagtgagccgagattgcatcactgcactccagcctaggtgacagagagaaaccctgtctcaaataaataaataaataaataaacaaagttataaggtttccttttctcaatttataaatcttgttattttttttcagttactttcaacccattgacatttttcttccaatcacattctttcttccctcacattcctacctgctaagcattccctgaacactagaactgtggaagtggtgtgtgcctattccaggccttccctccctccccctgtatttcccatgcaccatcctttggaccactcctgcccaatagaactttccatgatgtcagcaatattctgtatctgcgctgtccaatatggtaaccacaagccacacttgaaatgtggctaatgagactgatgaacagaatttttaattttacttaattccaatgtaagtttaaagagccacatgcagccagtgcctactgtgttggacagcacggctgtagcccttccctcatctgccagctggaagttgaaactgagggtaacctgggagccacctattgcagacggtggaggctctgttaggttgaggccctgaatgactgcatggagcagagcatacatcctattgccacaccctgctcctgatcagaaactttatgtgagagagaaattaacacccaccatgttaagccactgaggttttggagtttatctgttagagcaactactatcaccttaacaaatcaggtcagtctgctgttactgtaacaaatcagccaataggctggctccgaggacaggaagataagtaagaagtagcccctggcttcaaaaagccccctctcaggacgatacctggtccacaagacacatgcaatgtcatctgcagaatgaatgaatgcgttattccagtgttacacttctcatttttcagctaaattagaagctcattgagggactggaccccattcccccaaattacgcacattatatattgtattatgtgtattctatacagtgctagcaaactgcaggggttcactaatgaaggaatgaatgaatgaatccgtggaggccagcagccccataaaaaaccctgctgtagctgggtgtggtggctcatgcctgtaatcccagcactttggggagccgaggcgggtggatcacaaggtcaggagatcgagaccatcctggctaacacggtgaaacccccgtctctactaaaaatacaaaaaaaatagccgggcgtggtggcgggcccctgtagtcgcagctactcgggaggctgaggcaggagaatggtgtgaacctgggaggcggaacttgcagtgaacccatattgcgcactgcactccagcctgggcgacagagcaagactccatttcaaaaaaacaaaacaaaacaaaacaccccgctgtcggatgctgcgggctctttctccttcctgcccaccaaggctccccacaattgctcttgtccttcgtttcccgtctccctccttttccctcatcacctctcacatacaatcgctcaacggatgatccccttactctcgttctcaaagctgtggaaattctctgttataggcccgtgtccccctcaaaatgcatatgttgaaatcctaacccctagtccctcaaaatgtgcccctatttggacacagggttgttgcaggtgtaattagttaagctgagataagatcatactggcaggggttgtgggggttgggggggttgggccctaatcccacatgaccagtgttctctttaaaaaaacaaatttgcacacagacagacacgtaggaggagcactatacacagaaaaagacagtgattggggtgaggcttctccaagacaaggaacaccgaagatcgccagggaatctccagaagcctggggagaggcacggctcaggctctctcacagccccaggaggagccaaccctgccgataccttgaccctccaggctccggaactcggggccatacatttctgttgtggaagccacccagtttgcggtactttgttagggagccctaggtaacaaacacatgttcccactaacttttttgatagaaagggatccactggtaccgagaaagaagcttctgcgctctctgggggcctcccaggcccagggatctcttgtattggtgagtttgctggaaaagcatcagagactcccctggaggcatggccaggtgtttcccaggatgctgtgatttcaaactttctgtcccacttttcctgatgaatacacataactctcacttttcaagcttcactattccactctacagatcacaggactcaggcgctagattcaccatcatcacaaaaatattagaaaatttttctaattttccacaaggcagattcaaaagccacagcccttattttctgggacatcaagtccaagatcagtatgttgatgccaccatgtcatttattttaatttgcttggtggttcactgaatacttattgagcacctactttgcatgaggtgctatgggatgtttttgtcaaggctttgaaaattagccgggagaatggatagaagggagcttggcatcatattttattccagaacctgcccgtctcctggagagccgctgtgtaaagagccatttgcaagctcatcacagtgattagccagaagcaagcaagcaagcaagcaagagggagcctgccattcctctcccggccccacctggagctcacaccttctgcagcctgtctgcagccacactcaggccctgcagggggcccgcctgggccaggatgatccccagaagacaggtctgcttccccacaacttggaagctaagtggagaaaaatgcacctttctggctaacagaacacctcctcacaaggcccccatgccaacgacagagtcctggcagagcgtggctctgtcacactcgagttagcacagccaccaggagttgggtagttctcagctcacgccgtcctccgaaaggctctagcaaaccagaaatcaaagtggagccccgctgcatgccagctgacagcctgcagcagataaaatggcaaaaaccactgctgctgccggggctctggagaccctccactcacacacacagccctccaggtcactgggaagcatttcctgccacccccagccttccctgggtgcctgtgtccttgaccggtggctccagtgggcggcctcccaggctgtcactggccgctggcccactctctgcccacctcctctgccaggcctgagcacgccagtctttttggccagagcgaatcctacctgtaggattttcacttatctctgtaaagtggaaaaaaagtcaagcaagtcatattggaaactgaagccaaagcacttaacctcctcttgggaaggagttctcctcctgggactggctttgctgtgccaagttcaggaaagaaaagcaaatgtgagaacaaaggtgcctggctgtgccgcccggctgatgggcaggtggctggccccgctccatggtggcggcacctggccaagaccatttcctttctccacagaagtggctgcactcacacctggtaacgtcagcagcacctgagaggagcgcagaggtgcagccactgatgcccaccgagaggcagcgtcctaggctgcctgaccccagcgtgggagcgtgtctgagctgactgcattgctgaaccctaacttccccgtctctgaactggagatgatcccaccacgtactcatgcgtcttcggacgcttaattaatcaacagtgattgaatgccttgaagtcgaagcatgctggaataaacagcacctctggtgaagaggagtcactgccctggccttcggctcagatgtctggatcataattcaaggctagtcactaattttagtgtgtggccttcatatttctgtttctttgcaatgcaggcaattgactaaatcaccttatggtttcctgctctttgtctggattgacggatttgggcaagtttcccctccagcctccaggctgcagagcccttccctgctctcctctggcagtcaccacccacctccttctttgctcattcatgcctcctccaggcctcagagaggacaccctctccgtgaagtcctccctctgcctcgaccacaccccagcgccagcctgagctgagttcctcctggcagccgtgcccccacttcccctccagagcactgccccttctcctgggctccacagagagggcagggactgtggctgtgtttccctcaccagccggtacatggtgtgacacacagcaggtcctggtgatggaagaagtacacaatgcttgggtcacgactgacctaatgaagaggttcacccaaagggaatgagccccttccctaatttcatgggtcttcaatgaaacccaagcccacaaaggctttttagtggacacaggctgctttaaaggaatcaataaatcaatttccaggttctcaacttcctaaaattgatctgccaagaatgtgccagcattctgcagggtcgtttcccctccccacccccttccacaacagtcttctctatgaacagaagaaagtccttcctctcacccatcctgaattgccttggggtgcaaacacctctaggacactaaaaaagagacaattcctgaatacactattcttgaggactctttaaggtcaaggcagggagagcttcagaaagacccttgaggcccggcacggtggcttacgcctgtaatcccaacattttgggaggctgaggcaggtggatcacttgagatcaggagttcaagactagcctggccaacaggtgagacaccgtctctactaaaactacaaaatttagccaggtgtagtggtgggtgcctgtagtcccagctacttgggaggctgaggcgggaaaatcgcttgaacccaggaggcagaggctgcagtgagccgagatcacgccactgcactccagcctgggcaacagagcgagaccctgactcaaaaaaataaaataaaataaaggagagaaacaaaataccatatgcaagaaaggaaatcttttaacatgatttaaacttataacaaaaaattggacctgtttacctaaaaatgtatgaagtgatacatagtttttcaaaaattattgtagggtctatacaggaaaatagattggggccactgcatgaattcataggcaaggggtgccagactggggaggagcacagcctcctgccatctcccgaggaggagtagtgcagagctgaaaagcccgggaggatagatgagggagagacctcagattcgaagggcccctccttacagattgtgggacacgcacatttgcttccccaccagacctccgttttctgcctgttcaatattttaaaggtgtttctttggatttgtcgttgagtctacagaacagagagaagtgaaaacctttttaaaaaggaaaggagagaaccttttaaaaaggaaaggagaggtctagaaagactgagaaaagcatttggggactgcagtgagaatgaacaacagaaatcaaagtaagagggaaattaaaagaacgaagaaatgtaaaacgacaagaacaacagcaagttagtgatttctctaaaatgcatcttgtgagaagaaagctaggctttctttttacaggaactcaggaagctgtgaattcagggggatcctagacttgagtagaaaaacaattacctcttattttcactaacctctagctgaaacttagcatttcctttaattataaatgtggccactgaaccacagtagtattagcagttcctgtggtttgttcccagtagaaatcacagatattttcatatcccattaccagtcgctgcaaatatcttgaaatattatttacccttatcactacttcaaagttatggtggttattaaacctgcatgagatcttgttatgtaacacattaataaaaagcacatatatactctatcacaaatgggttttttaaaatattgataattgtatatcaatataattggttttcattgtaatcctctgtgtttttttaagagacagcatttccctcggtcgcccaggctggattgcagtgatgtcatcatagctcactgtaacctgaaactcctgggctccctcctcagcctcccaagtagctcggactacgggaatacattaccatgtccagctcattttcttttttttttcgagacggagtatcgctctgtcccccaggctggagtgcagtgacacgatctcggctcactacaagctccgcctcccgagttcacgccattctcctgcctcagcctccgagtaggctaggaccacaggtgcccgccaccacgcctggctaatttttttttgtatttttagtagagatgggggtttcaccgtgttagccaggatagtctcgatctcctgacctcctgatctgcccatcttggcctcccaaagtgctgggattacaggcgtgagcaactgtgcctggccaaattttcttaatttttttttgtggagacaagagtcttgctgtgttgcaggctggtcttgaacttctggactcaactgattgtcccacctcggcctcccaagcgctggtattacaggtgtgagccactgtgcctggctgatatttaatacaatactatgcacttaaaaacattgttgtaaaacagtgtccatagactgcaaaaggggtccatggtgaaaaaaattttttaagaatccctgctttaaacccatactccagaaactttctatctgttcatggtgatagcaggctgcggcgtctacagggagtgaaaactcaccgcccacactagagaagtggcatgagttaggctgagggcagcaaacgctctcccagagacctgctggctacactctgggtctcagtgaagagggcagcatttcccgtgtttagcaaatgcaccagcctcaaacacaggcatgccgctcgctctccagcttcttctaacccacgattcaagcccctggagaaaagcagtcccagagccccaggtttctccccaaatctcaagtaccacaaggtgttgcacctcagcaaggaccttgggtggcacatgtgagtttgaatcccgctgcgtagcctcccttcagcttttgcgcaatttggcatctggagtaaccagagagaactgaccccaactctatcctcaacttgcaccagcaaatgggccctaaacaaaagtctctggaagtcgacagcctggacctatcaccatgattcagtgagaccagcagcatgaattatctactaaaacacagtaatgctaattttatccctgtcatttccctgcttgaggaaacaaggaaaactcagttctttgggaggggtcaagggaacaagaagaagccatttttctcaggaagccctggggagcagtgcagagacaatgaacttggaagtcagaccccggcgctcgctcagtatgggggcccagggagagttcataaactttcccagccccagtcccctcatctataaaatcatgtctgacctgccagagtgcttgaagataaaaaagcccacccgcatggtgctcttcccttccttcataataaaacagagggattcctcaccaaggaaggcggtgagaagtatctttttcaagagaaaaaaacggcaaaactaataaaattgtgtgcttgtcaggagcaaagctagcctttcttcctctctctctgactttggttgaacttgaaatgctgtagcaatgctgcctgcctctctcttctgccagaaatcttccaggttttttggtctagaatcagccagaccttgctgagcatctgaatatttgctaacaccacaaagcagaaaatctgctcaataagcctgtcttaagcaggggctctggcctggggttcagaaaccagggtccctgagctttggggagggagaaagaggctcagagctcccaggcactgatacagtcaggggattcagaggtcccagatctgtcaactggggcaagcaaagttcccccaaatttaaggcaccaacattttgccagctttttatctacattagcaagcaacaataagtttttaatcagtcattataagttattttatttccttttttttttttaagctacagagtcttgctctgttgcccaggctggagtgcagtggcataactggaagctcaagtgatcctcctgcctcagcttccaagtagctgggactacaggtgcttcccaagtagctgggactacaggtgcttcccaagcagctgggactgcaggtgcttcccaaatagctgggactacaggtgcttcccaagcagctgggactgcaggtgcttcccaagtagctgggactacaggtgtgcaccacacgccaggctaatttttaaatgtttttgtagagatggggtctcactatgtttcccaggctggtcttgaacccctgggctcaagtgatcctctctcctcagcctcccaaagtgctgggattacaggcatgagccaccacgcctggccttaattcagttttcttattgtcctatcaaattatgaatttgtggtaaaatacgtaaaaggccctttggtgtttttttgatttttatttttccattcaaataaaaataattttcacaaatccgaatcacaccacccctcagagagcacgctatgcttttcagagtggtttttgattaccattttcaatggtaattggtaacaatggtaacagctggtaacagctccaattttttgttataagtttaaatcatgttaaaagatttcctttcttgcatatggtattttgtctccctcctttattttattattttatttttttgagtcggggtctcgctctgttgcccaggctggaatgcagtggcatgatctcggctcactgcagcctctgcctcctgggttccagcgattctccctcctcatgggcactgggttcactcagctccactgccccaacctatgtctctgagccagcatggatctcctttctgttctcttggtgccgatgagctcattttttgacatttcagcttcttgtgacttgcctttggtttggttgttttacttttaatacttttgccagcaaagacctacagcctctctgaacctttttgggactggccctggtcagctgtcctttgatctccatattcatactttatttggaaataaagctttgttatcatatggaatccagagtcttcaccctgtctgtgaagcaagtacgggtttatttatttagggctgggagacatctctgatttcatttggaagctgtcactttgcttttcctttgccctatgagagactgggttgctagaaggagtgaagatggtctattgtgttccttttcatcattatctcattttgttgttattttctatgtttctctctttaagaaatcataacagttttattaagatatagctcacataccatacaattcacctatttgaagcatataattcaatgcttttaatatattcacagaatggtgcaaccatcaccaccatgaattttggaacagttttgtcaccccaaaaagaaatttcatatgcattagcatttactgcccatctcctcccaatttaccccctcacactcccacctccaggcagccactaacttatttctgagtctatggatttgcctatttgggacacttcatataaatgaaatcatacaacgcatggtcttttgtaactggattctttcacttagcatgatgttaaatatacatagtatcatctgtatcagtacttcattctttgtattgccaaacaatattgtatggatataagttttacttatcagttgatgggcatctgggtatccacctgctggctgttacatacaatgctgccgtgaacgttcatgcgcaagcttttgtgtggccacatgttttcatttctcttggatatagacctaagactggaattgctgggctatttcctatattttaaggaattatgttactctggaatcctgtaggggcctttttacccatggctcatttatttcttctcaggcctttattaaacaagtatctagaggtgtttagaaggttataaattagccacagtgacaaataaaccccaacatttcaatggagccacatactcaaagtttgtttctcactcacatctcagtccaatgagggtgttcctggttggcacgcagctttccctctgtggtaattccgggtccagggacatctgcttctagaaaaccctggcccagctttttccattggtaggaacgtggccccaagccagtgcaagtggggctgggaaacactgcctctggaggggcaggtgctcccagaagcaacctcatggcatgagagaggaagcacagatgttggtggtcagctagctgactgccactccaaggtccaggaagccagagggcacggggttacaggggatttgagccaggatcccagcaaggtcagaagatatttctgtctccctcctatttcctctttttcttagaaaggagttatccttgtgttcaaggaaaggctgaatatgagcaggaactgttaaatatgggaagcactgacatttggagaagactgccatagatttttgcatacctggtatttatttagatggtcttctgctggaaacagtacggacccctccctcttcttggaaggactatccatcaaggtaccccctgcctctggccacaggatggacacttgacccacagtaggccagactcgcccctctctctggaatttgaaccttaagcaatgtgacacaaaaacagtctcattctgggggtggggtcctgagaagataccatccattcctttctgcttcttggatcccaaatgatgctgcctcagtgtttctggagcctgacaccttagctttgactctgtgggttgccccatgagcttacaataaaggtctggttaattaagccggagttggtcattccaacatctctctcaaccttctacattcaagtcctgaggatgtcacatcctgtacagcttgaatctgtcttctttctaacacaacctccaatgctacaattcaggttctttctattgtttgcctggacttcacaagaccggctaactactaccttcatgtccccatggaaacttttctaaaatgcaaatactggtttgaaaaattacaataccacccttggagcagcgaaattatgcacccatatactgttggtggagttataatttttataaccttttggaaaggcaatttggccatatgtatcaagagccattaaaaaaaatacagcctttgacccaacattttcactcgcaagaatttttttcctgaagaagcaattagacatacatataaaggtttatgtctgaaatgttctctgaaccatgcattcattcaacaaatatggaatgcctagtatatgccaggtgctattattattacttaaaatcacaaaatactgggggagtaaaagaactgtccagttagagggaattgattaaatgaacttagttgtggttggatgatagaatacgatatagttactaaagaccatgtttttaggagaatatttaatgacatggagaaattcacattaagagaaaaaagccagtttcaaaaaagtatataatctgaatgttgaaggaagaaatacacatacaccaaaatattaatagtgactaactctaggaatgagatttgagtgatttttactttttgcccacgtttccatatatttctaacatttaataataaagagaaaaattatttttaaaaaattacttaaaaagcaatcaggaggccaggcgcagtggctcacgcttgtaatcccagcactttgggaggttgaggtgggtggatcacgaggtcaggagtttgagaccagcctgactaacatggtgaaactccgtctctactaaaaatacaaaaattagccgggcatggtggcatgcacctgtaatcccagctactcgggaagcttgaatccaggaggcggaggttgcagtgagccaagatcgcaccactgcactccagcctcggcgacagagtgagactctgtctcaaaaaaacaaaacaaaacaaaacaaaaaaaaaacgcaatcaagaaatatgatcatgactctacatgaaacccatcaataattcttcatttgcagaataaagtataaactgccccagcatcagctccccgacatctcccacctccccaccacttccccagttcagctcgggaagcagccacgtccaccagcatctcagatctttcatacctcagggcccttagccacgcggtaggcccccttcctgcgactgccccctccgtctttgctcattcaacaaatatttattattctgagctctgttctgagcactaaggatgccagtcaacataatagacaaagtccctggctttgcctccacttgttgcggatttcatgtcccagcagaggaagacggataacaaacatatacacaagtagagatgagttgtgttagtttcctatttctgctataacacattaccacagatctagtggcctaaaacatcacaaattcattctgtcccagttcttgacgtcagaagcccaaacaagtcttgcagggctgaaatgacggtgtgagcagggctggttccctctggaggctccaggggagaatctgtctccttgactttctcaggtctcggtggccccttcctccatctgcaaagcagctccgcagtgtagctctctgcctctggcctcctgcctctctcttgtaagggctcttgtgattatgtcaggcctacctgaatgatccaagataattttcctgaaatctcaagatccttaacttaatcatgtctgcaaagtccattttgccacataaggtaatacattcacatgttctaaggattggaacatggacatactttaagggccacgattcagcctaccccgtgtgggatgtcatatatgttgagtgctttggcacaagggaagtgagtttgctcttcatgtgagggagtcagaaaaggcctcactgataaagagacatcagagtgtggagcctacctcctttgacactcctgtcattgtgcttgcaaaagtattcattttcctaatcccagcactttgggaggctgaggtgggtggatcacttgaggtcaggagttcaagactagcctggccaacaaagtgaaaccctgtctctactaaaaacaatcatgtcacttgcttactaggattaatttgggaatccagtaaggatacaaatatggtaaacttctagcgcttgtcttattgcaggaactccatcaatgacagacagttgtgctgtgatattgggggtgaagaagagttgatagaaaagaagttttgagaatttgttcctagtcacttaaaatgaagctggggtcagagctgaaggcctactcgatgtcagcactaccctccccagcctgggccctcggtgcctttttggcagggacctggtcttcctcatgtcgtatcttccacagggcctaggacatatttgcttagctcagcaaatatgtattgagcgcctgctgtgtaccaggaactgcgctagaagccaaggatacatgaagaaacaaaacagaagcggccggactctgaggccagtaagtctcatggggcaaaaaggggcctgtatctcggccgtgtggcgacgttatttgcctcaaaaaacgcctaggccggaacccctgcatttcaggctcctgtggaattttgagagaagacagtactttcttaagctgttccgtattttccatgcaggcttccattgacagaaatcccactttgcatctgtgaaatttgctaacgcacgattctgctctagtgcatcgtgaggcagtttatgacatccgtgcagctctggtaaagagcatgcttacaacgagggggaaaagcaccgccgcaggagcagagcagtggactctcagggaatttccattttctcctgtcttagcgctgttaaccatcacgcttggcgttgcctgacttcgacatgcgatcacggctgctagttctgagagaatgtgagtttcctggtgaaactctctctcaactctaagatggaccttgacggaatgccaaatgtctctggccttccaacatgataaagggcctccacgatgctttctgcttttctccctctgcaaaggtggcagtgaggagctttctctggtggctgttgcatggaccctgtccccttggatggctgtgcctgcagattgtcaggccgttgtctctgcttccccagcccgcagaaaggtcaccgacagggctgtggcacatgcaacttggccctcaccgtggaggagatggggcagcttctgtacaggttctgatcaggtggccacggcaatgactggggatgccagggacacactggactgtcccgagcacggcgacttccctggttttgctacctctcttccacctgcactgcactccggggctctgattttcaccttgctcgctgacccccgcctcctgtttcatgggtcttcttttcctgccatcagcatcttttctctgagacgccgcttggattttctttcctgcctgtttgtcctagacaccggcaggagttcaagaatgatgtgacacagtgatgtggccatggggtctgtgcagactgacctggcctgtttcaaaatttaaattttgttttaagtcataaaagggctacaaaagccttacactaaataagaaaaactatcccatccgggggcctaatccctgccccgttctgctcggcttgcctccctcattatacttgtataatacagtatggtttctatcgcgtatttccttcctgtttttacacttattcttgcttcactgactttattatcggcagaattttgcagcattttttttacacagccataaatactcttcaattcaacaaatgcatacaaatggtttccattagaattttaatctactctcaaaatgaaagaaaagcttaatataaatctttttaaattaccagaacataaattcacacagggacagttcctcctaggccacgcacaaggggtcgcatcctgccgtcctccctcagaaattaattgagctctcttgccgccgtaaacgaacagtgcatctggaaagatcgtatctgtcaagattgcagattggtttccctcagactttgtaaaagtcacagcttacaatacgttcattataccgatgagaatggctgtcctcccaactggaaagaaataggtgttttgttctgttggaccaagatttacagaaagcaattttcctccatgcaggagatatgacaaacctgctggaaaaaaatgtcatttcacaacttctttcatttcatcacctttttttactgctagatgtagattctctcccctgtgcgaacgggctgtagtgacatttaatggctaagtgagggagtcaccaatgagtggaggcacctttctgaggggctaaggtaagagggtttccatgcctctccctctccccctatgtccggggctgtctggaagcgtcccagcatctgccggagtgagggagggacgcggtgagtcccttgagcccctcagccaacttgaacttaggaactcatgtgaatcttgtgtctctctcttgtaagcagctgaagttgcctcagttttcctgttgtttgctgagcccaagaaccccagcgtgcccactctgtccttggctgacagcagcacgctgtctcaggaggacggctgaagggcagagtttgggcttagatgttttttttccatttcctcatgtcataacctaatgctgttctagcagagcttctgcatattaaattgccttttagccactgggaagggggtggcgtgatctatggagaaaaggaccctcatgtaaatgtatgatggtgacacaaccccacagaggagaaagggcaagactaacccggagaccaggggtcagcaaaccccgggaaacgtcactctttacagccacttctctctccttgagtcaagagccactgttccgagctttccgtcacagcagctcatggcagccctatcaccgcctgttctctgggctggggctggtgagaaggccgaggaagtctgaggcagggtgtgtgggagggcttttggttccaagagcttctctgagctctgtgtaccagcgagaaagcaggcagcgaaggcaagatcaaaccttgctcctgccaagcgggagaggctggcttcgggtggtaatttgtgctgcaggtgaggctccctacctgggcggccacttagctgcaccaggcagggagggcagggccaccagaaggcctggtgggcattgtttccatgggctggaaagatttttgcaaatctttctgcaaatgatgatctctatccacataaagtggcataatagcctctttgctttaccgagtgctgctggctgttcaagtgcttatttcttgattcttggcccatttgctttccattagcagtaatcccaagcctgcaaaactccaattactaagtgataatagaaatgcagctctgcctcggagtctctggagctcagggtccagagtgggccagggttccacgcacagccacattgcaatcatatttatgacatgtgagcaagacatctggccggtccctgggttaaagacccaggggagccgagtgggcattctcagggggtgtctgcaccgcagatcccagggagctggtggaaacaggacaggtgttcccaagacagtccaggatgctcagacagcgtaggaggaatggaggctacaatggacggagctgaaggaatgtgtgctgctcctttgaattctggggttggaggaaaggtgtgctagggactgagctgtgtccctctcccaaattcatatgtcaaaactttaaccctccatgtgagggtttttggaggtagggcctttataggtaattaggtttggatgcagtcatgagggtatcgcccttacgatgggattagtagctttctaagagaccagagccgttgctcccggccccactccctgccaggtgagcccacagtgagaaggcggccgtccacaagccaggaagagagccctcaccagaacccggccatgccagcacctgatctcagacttcccagcctccagaacagtgagaagtaaaggcttattgtttaagccgcccagtcccttgtatttagttatgggcagctgagcagactgcaacaggatgacaggagagagaatgattgtagattcagagtgaggtggggctcaaagtcagaacttcagaactgagcccaaaatgatcagaaaattcaccccctaggtggctgctggtgaaaattcactactctaggggccagggcagctgttttgtatgtgtgtgtgtgtggtaagaaaacaaaaaaacaaaacaaaacaaaaacaaccacacacataataaggccaggcacggtggctcacgtctgcaatcccagcactttgagaggccgaggcgggtggatcacttgaggtcaggatttccagaccagcctggccaacatgatgaaaccctgtctctactaaaaatacaattagccggacatgtggcgtgaggctgtagtcccagctactcaggaggctgaggcaggagaatggcttgaacctaggaggtggaggctgcagtgagctgagatcgtgccattgcactccagcctgggcgacagagagagattccatctcaaaaaaacaaaacaaaacaaaacaaaaaaaacacataacataaaatttaccatcttaaccatttctaagtgtacagttaagcagtgttaactatatgcacactgctttgcaatcaacctccggaacttttcatctcacaaaactgaaagtctgtatctgttaaacaactcccattttcccctctcccaggccccgcacccaccatcctactttctgtctctatgtatttgacactcacatcatctcgcgcaggtgggatcatctggtatttgtccttttgtgactgtctcctttcacttagctcactgtccaaagttcgtccatgcagtagcatgtgttggatggactttccttccttttcaaggctgagtaagattccactgtgtgtttacattttctttatccattcatccaccgaggaacacctgggcgacgtccccctcctggctgctgtgaataatgctgctctgagcatgagtgtggagcgtctgtttacaaaggagatggtcagacagtacaacagcactcaggtcagtccagctgccccctcatcccaccagctccttcccaaaagattgaccactggactttttctcataggaagcactgccctccgcaccaagctcccttcacatcctgatcagcgctgctctcggctgctgcttcttgcttcaagcccccaggaatatctcccttttttttaattccatttctctctcaaccttaaaactatccaccacccttagtctgttccattatcaagcccttctgctgactttcaccaagcactgtcatttcttcttccacattttctttcaaattctccaagatcctcttttaaatatactagcaaggcagactcgcctgacttttccctagttcacacctagggacaaacagatccaaaaaagtcaatagaatttgtaggggatcctgataaggacttggctgatttttgttgcctggtttagaccgctgcagttttgtgcccctcagaaatctcataatttatgactgctgccagcgggcaaaaatgtggagcgtttgtcctcaaacagagtctgttgtaaaagtgttctttctaacggtaaagagcagcaaagaaaacaggctgctgtgttcttcctctctgatgcctctgacctcgttgagtagcttctcactcaaattgttcattgtggcaccagccacattctttttgagattttaaaaaattaacagactccttttttagagcagttttagttttatggaaaaattgactggaaagtatacagagttcctatattaatgccttggtctcctccccaccatcgtttctcctattattgacaccttgattctgactctggggctgccctctctcaggaactgcagctgacctgggtgcccagtgcctgtcccacgctagagaggatccgagtccagcgtctagctctgcacagtctttctccactgcagtgggcctgactgtgatcagccctgctctgagacaggaaggcccgagggctgttgcgtggcccatctgcaggggcatcggtggtgtgacaggtgtcccaccatgtcacgtggggtggatgtccactgcctgaaccctgaaggccaggcaaggagccaaggccaggggggcccagcgaggagcgtgtgtccctgggagtatctgggaacctacccaggaaggcagtcccatcacacacagcaggccaggaaccagagactttgcttagtgatggcagcagtgcgaacctctagagctgtcctgccgccacccaggagggccctcaatagagtcatctactggccaagctggacttgtccgagccaatcttcggtttctcagcaccttcccagtttggggtgtgaggttgcagagtggggacaaagtcccaagtctttcttataatagcatcctgcacagagattactgtaggatggtgctcccagcggggaacagcatggcccctgccacacagatgccaagcagtccctgggggtggaatgacagacgccctctctaggaagacactgtattacacacaaggagtggagtcagtttataccatgccctggtctgccctggagatggaaaagggagtctgactggacaatggagagctttttggatcaagacttccatagatccagtgtatccctttactcagtcagtcacttaatatctacttatctgaaaacactcaggagcccaaggcaggcagatcacgaggtcaggagttcgagaccagcctggccaacatggtgaaaccccgtctctactaaaaatacaaaaattagctgggtgtagtggcacgcacctgtagtcccagctacttgggaggctgaggcaggagaattgcttgaacccggggggcggaggttgcagtgagctgagatcgcaccactgcactccagcctgggtgacagagtgagactccatctcagaaaacaaacaaactaacaaaaaaacccaaaacccctgggccaggcactgttctaggcactagagagtcaagaggaataaagcaggcttggccctgctgttttggggggacacaaacagaaaacagtaagacaaatagacaaaagagttatgtaaagaaagaaactgggtgacctgatggttactgggaggtgggggtcttgggggtgctggtagacagggtgggccagggtgggcccctctgaggagcggactctgagtggaagtgctggaaataggaaggaggaaactgtgggaagagctggcggagagaattctcacctgggaagaagaaatagcaagtgcagctgccgatctggaaaggaacgctcgagaaggaaaacaggccggcaaggctagggcatcaggaatcggaaggcaggagcagagaggctggaaagccagctgtggtggagggccacagactacggctcccatttgcctgccttagcacccagcttcatgagctgtcccaagaccccatgtcacttggcccagtgtcttggtatgggcaccagcctccaagctggggaacctgagttctcagccccgttctacctctagagctgtgcaagcctgcctaagtcctaactgcatgtccttatctacaaagcaatgctggagatacgattctaaactctaatattctccagcaacgactgtgccatgccggccacacagatgactcacaaagaactccagcactcccaatgccaaggtgccgggcttgcattgacagagtccaggatcttcgcctgcaaaccctgctgctgctcctccgagagtggaaacctgccaacccgcagccgagggacagtaacaactcacttggccagtgagcaatgtcacagctgtgtccaagagaggagaggcaggaggaaagaggtaacaggcaggaagcccactcccagacaatgagcgtcttcagagtcctgacgtagcagaagtctaaattgaaacatcccggtgcagcggggtgattgcactaaagcaagttggcaaaacatcagacagcaggtaccatggctgcctgtgacgggaggctccggctgacttcctaattgggccaaagcacctcgagtgccctgaagttcacttgcactgccatcagcggctaaaacaaagaatcctttcatcaattaaaatgtgtttccaaggcagcgttttgctcttccctggaggagctgctggccttgctcttgtgatctgtgctggctttgagacccgcagctggggctgcaaacccagcaagcctggagcccccgcccaggcctcagcatgtgctgcttggacttagccctgctatggatttagtgactgttcactttgctcctccctactcacgacccaacagacaatgtttagccaaaggtgctttggggcaggaggggcacactccaccttggtctcttctgtgcgtgctcaccgtgactcagagatgctcggccatgacgcttctcatcaatctgctgctgctgtttggtaaagagccccactttttcgtgggtgggggggggaggcatgtgtggccacgctgctcctcacctctttttcctgtgattctcgtaagaacctttcagaaccctctcctccctgctcccacccctttaaagacagtagtagctgcttaatcaaaatgtgcccatgagcactgatgttctgagtcggtagcaaagggctggatgtatttatatgtgtatttttgtcaggcacttatcttatgccagtgtgcgccttcctctgcctcctgggtatgacctggggccagcctgtttctgtcaacggcaccagggaaacagtagaaaggagaggaacgtagagtcgttatgagtctgtgaaatttgggaaattaaatgaaaagtccactgtgccctccactcagcctctccctcttggaaggcagagctgcggggggaaaggctgaaatcagcttcatttccctccattcctgactctaacaatacaggagaatcaaggtcagaaaacatgcagagaacacgctcacagtatggagtttcttctaagtaatacttttctgattcattttattacaaaattaaatagttgatccatttgaactctcatgaatagatattaaatgttgcttattataagaatgctaataaatcattagtttttttaataaaaaaaattaaccaccaaatggctaacaaattaaatttaaatcattaagtctgatattcctagagaggatcacagggggtggtacattagagaacctgtttttattttgtttggttttaaacacaaagagcccgtgctggctgctggctcgagcctccctggcccctttccagacagcagcgagcatctgtgaggcagctgaccaggcggagcggccgtttggagggtggccgggctacctgggctacggggccgagtccgtgacctcagcctcattagtcctggctctaaccagccgcgctaatcagcgccaacatgtgctgctcaggtgttgattgctctgttgctcatcaccccttctagggctgccacacgtaattaaaagctctaccgcgaagatggccaatcagcctcagctaagcttagaaagaactattgtcccctctcagtgtaaaggatgcaagaaacaggaagcccctggtatggggacacagtttaatcagaactcagagcgcacctttccagctgtctgcctggactgcagagagaccttggctgaatatttcatcctcttgaaatatactgctgcgacctgactgaacattttcacacaggggctttaaattagaagagagtctgtgatattctcattcgtaaaaccataacaaactgtttcatttgatcagctgcagcaaaccaagatagcctggtatataccaagagtttgtctattttttttcttctcttaaagcaatgatattaatcataccttgcatattcactatattataggagataaaaatagaggtaaaaagaaaatgatcaattctttaaaaaaaaaaatctaattcttcccccatcaggtgatgtcatccgggccaagaaatgcagacatagaaaggggcaaagtcttggtggtgcgtgcctgtaatcccagctactcgggaggctgaggcaggagaatcacttggcccgggaggtggaggctgtggggagttgagattgtgccactgcactccagcctgggtgacaagagtgaagctctgtcaaaaagaaagaaagaaagagagagagagagagacagagaaaaaaaaagaaagaaaaagagaaagaaagaaagaaagacagacagacagacagacagacagacagaaagaaagaaagaaagaaagaaagaaagaaagaaagaaagaaagagaacgaacgaacaaagtcaacagcgaacagacacttccaaagtgcctttcgggctataaccgtactgtcatctaaggcagctggcacctcaaagcatgagcctacagattctttcatggggtctaccctgtcaaaatgatcttcattataatactaagatgttttttgccttttttcactgtgtggacatttgcactatgcaaccaaagcaatggtgaggaaaagtgagggtgaaggaatcagaggcagtggcgcccacgtgcactcttcaccaccacatgctcagggaagaaaacaaaggcagagaagtaaaaagaccatttcccttaagatgtcctcagcgatgccggcaggaaaaagtattacttgtagggaacctccacgttgacgagtcatctttttcacacttcctgggtgagatgggaagcgtgcatgaagcacctctgcacgttgtccttaggaagagtgccacgctcttcctgtttgagttgcaagctcaactagcccctttgttcatgggatgccatttttacttcaaagaaagagtgactgtggatactcagatttggggacatgacagacattttcttgaaaatgaacaaagtaagctatttatcactttgagggaaatgaagtgatcaaatgataaaattcacgctttcaagataaaatccgaattttggaaaacttgttatcggtcactgtgaacttgacagcttcccagtacttaaagagagagatttttctcaaattagtggtgatgtttacaaaagtgatttggggacgttgtataatgaaatgtgtcaagtcttgaaagatctgcatcattcaatgaactggtagtttccaaatgaccaatagtatcatgcatgggttaaacatcaattcaaaatacaagatagaccaaatgattttaatgtaagataataggaaatactcattaatatgatttcagatttcacattgcaactagcttttaagaaactttcatatatcaaattgtggtgtggtatcaaagactatccacaattttctgaaaatgctattaaaatatgcctcccctttccaactatatatctgggtttggctggattttctccacatatttcagccaaaacaacttactgcaacagatagaaaacacacagaaatgagaatccagctgttttctattaagccagacacgaaaaacagttgcaaaaatgtaacacgatgctgcttttttcattaaacattttttgttgttctggaaaatagttattctttcgtaaaagtatgttatttatgttaacatgtaaagggtttactattggtattttaaatgaattaaaatattttttaaatttctcagttttaatttctaatgtaaatattgataaatataacccatgaaactaaagtttctttggggtcctcagtaatttttaagagtgtaaaggggccctgagaccaaaatgtttaaaaaaaatgttagcatgaggcagcaggagaaagaggctccagaagaagcagtagcacagggaatgttccagattaaaggggctaacgagacatgacaacaaaatgcaataccaaactctagactgtatcccatatggaaaacaccagaaagaaacgtattgggtcaactgacaaaattgggataggaataataaattaaaatattctaaccatgttaaacatattattgtcaataactatacttaactatactggatatgaaaatgtccctattcttaggaaacaaacgctgagtatttaggggccagagaccatgttgtaactgaccctcaagtggtatgcgtgcctatgtatatatatcactctttcatagctgtgaccagctaagaaactaagatttcctgcacaggagtttgaaagtcaacgtgaaggtcacaaaattcctatgaagcaagtatcatttttcaactcaacaacaactttaacactgaggatgcgaagaaccactgagtagaaattacacaattaaactgttatacaattttccaagcaaggggtatgttgtggccaacagcatgaatgacagcagttactagcctctttctcccctgcagcctcctctatcgaatgtggaatgccaaggaccctgtcagcctcccttgcagctaggggtggccatgtgactggctatggcccaagggatggaagagaatacttgctggggcttctgagaaagtttctgcttttctgatcaaagggatagccaagagcagagaagcctcatccccactctgccacccatctccttcttgcatttagtgtgaatgggatgcctgaagtttttgacaaaacaagcctgaagatataaagcaaaagacagaaataaagaaaaaaacctagatctttgcagacatcatggaccagctgacccaactccagcaaatgcttaccaccgtacttgttatgtgaggaaaaatatgctacttgtttagtcactgagagtcaggggcctgttacttacagctacatgcattactaatgcctacttattcagaggctggggaaaggcagaataaatcaaaaggctgcacaccatgcccacccctgcagaggaagcaattccagaacagaatgcccatttaaaacctggaccaaatggcatgtttaagtttctaacagttttcattaacaaaagttaacatacagaactcctacaacagaaagcattcaacagtgatttaagacctggaaaggtcaagaaatccactaatcggatgggtttcagtggaaacatcgtctctgggtgttctgccaagagtgtctgttattgccaaattcctcattcaaacccatatataagaatgctttaactgaaacgcagaagtcaaaaataagacatttaaacagtaatctcctgtctctcttaaagataaatgtgcccattagccctggctgctaacaggaagatttctttctcttacattccagatgacaatttttttcaagccattcacaaagaaatcagcatggaaaaaataatttaggaggttggctcctgctcagctacctcactgaattaaagtgcaatcaagtttataacttttaagtggaaatattaaaaatgtgtatgaagcccctctgcatagggtcccgtgcagacatggagagaaatggtagccaggcaccaagatacacaggatgccacatgcgctctgtggagtttccaacctcgttagagcaggacaagatacatatgaaaagttaaatgacatgtttcagtaacagttctagacagtagaagagatatcataaaacagtacacgattcattgccagaaagacagttgctgacaataactgctgcaggatttcaaagaagaaaaaatcacttcaagctcaggaaggtctggggagactttacagagagggcgggatccaactcagtgttgaaacatgcatggaaactgtggatggtcaaagggagcacaggaagaggctcttaaaaatgctgggtttaggccatgcaaagtggctcacgcctgcaatcccagcgctttgggaggccaaagcaggaggatcacatgagcccaggagtttgagaccagcttgggcaacacagtgagatcccgtctctacaaaaaataaaaaataaataacaattagccagggaattagtgtggagatgcatgtccatagttcctgctacttgggaggctgaggtgggtggatcacttgagcccaggaggttgaggctgcagtgagatatgatcacgccactgccctctagcctgagcgacagagtgagaccctgtttcaaaaaaaagaaggaaaaaaaatgttgatttttaaaaaagaaaaatccttcaaggtaggtgactggtgcagggaggaaggccgctgggtggctgaggcagacggggccaggttggcgaggcacactgcacattcaggaaaggatggctgcagaagatgggagcggcccaggtgtccattggtgcgtgaatggctaaacaaaaggcagtatgtgaacacaatgggcgattcttcggccttcagatggaaggaaatcctgacacaggctacaacctggatgtaccttgaagacatgatgctaagtagccagtcaaaaagagaaaattctgtacgattccacttatatgaggtactgagagtggtgaaattcatacagaaggtagaatggtggttgtcatttctgggaagggggaagaccgaattactgtacaatgggtatggagattcagttttgcaagatgcagagctctggagatggatggtggtgatggctgcacaacacgcatgtaattaataccactgatcttaaaaatggctaagaatggcagcagccaagcgaagttgtaaagtgggctccagagaagagattggcagttggctaccaaaaataagggcaatacctttcttcaggccccaggcctgagaccctcgggctccacacccgagcggtgagcagacggtatgcttttctttcatcaacagagaacccttcccctgattttcttgggaaatactgaactcattttaatttaatgaaggacttgtagaatttttttttttttttttgagacagagttttgctcttgttgctcaggctagagtgcaatggcgcgatcttggctcaccgcaacctccacctcccgggttcaagcaattctcctgcctcagtctcctgagtagctgggattacaggcacacgacaccacacctggctaattttgtgtttttagtagaggcagggtttctccatgttggtcaggcgggtcacgaactcccaacctcaggtgatccgcctgcctcagcctcccaaagtgctgggattacaagtgcgagccaccacacccggccaggacttgtagaattttttaaagtcttcggccttggaatcagggtaagaacccagctcctgcggacttcgtgtctggtccctgccctctccccagggtcttactccaatggatacagacacaaaataatagacaacccaatcacacagaaaataaagtacaggtggcacctgcacggctcagggatgcgggtggcaagtttgggcttcatctaaggaacttgtctaatatctagctatccactctgttctaactctcacccaagagccatcagagaacccaatacctggtaggtactcagtaactatttgagattcatataccctcacgatgaaatggctttagattcttccaacagttccgaaataaaagtcgagctagctaaaggtatctccagaacaattctggggcaccctgctctaaatgtgactcctgggcccagggttattttgccggcacctctgcagccagtaatccataactctagtcatcacggttccctgacaagagagcttgcaaagcacccccaccttgagttctggtccttccctggagctttagacaggcttcctggctaatgatttgtagaaactaccatttttagagtggctttactttaacaacaacaacaaaagtgaactataaatattaaaacttcttatcagcctcgccaatgagaaaactccctccctgcattcctcaggcccttttgcaacaacctaaatatttttaatcctcaggtagatacagacattggaagatcaaaaattacaccagggccacaggaacttcagctcaccgggcttgcaagcctacatttgtattcatgagctcagcttgtatgcttgttctcttattttgcttcatttttaatttaggaaaagatggctaatatattagatcactttcactgctgggtcttgtcaggcttcagaagtctttaaggacagactgctaaaagagtaaaagggaagaaagcagaaaatgtgtcagggaaatggagttcctatcatttcactcacaaattctgccttttaaatgtagtccttctaccaacggttcagtgaaagatggtttccttattgtcatttattagccatgacaggcagcaacattggctcagatacagtctcccttcaccacaattatctagtaatgcctgcgaggcaaaagactgcacaaaactccctccttctggaaagcttctccccaaggcaccagttcaaagcaaacctctattaactggaacatgaacatctgcagaattctctggataggacaattctactattcttatagtgatcctagaaacgaagacataatcactcacactccagtcaccaggagaccagggtcggttcataggtggaagcatcacaaccccccagcgacagcatctgcccccaaataaacacccacaactgacctcagtaccaggactccccttttagcaaggacccttcctgtcaacctcccctcaaagacagaaaaagaaaaaagtcaattttttttcactgaaactgaatgtaacaaccagacaagatataagatagtatcaaaattacataaattagatgccctactggcttatcagcccctagacatatttatcaatgtgatgtgatgaaaatgacacactccatcctaacaggactcacaactcttgtgacttgcggcaatagagaaatctctaattttctacctttaagtctactgattcttttttccacataccttttgttttatgtattttggagcaaacacagggcgaggagtttggaggagaaaagagaaggaaatttaggagagaagagaagagagacttggaaagaggataaggtgagaagtcagcaaagggcagaactcaggactgaagccttccgggaggacagaggcctgggccctaccagatagatggccacacctgggaccaggggcagggtacacaggagagagcgtagggctagcggctgccttcgcattttacataaatctgatccataaagcagccccagacatcaaccctggggaacgcacacagcttgggcatctcaaattattctttgagcattaaaacatatgtaatatgcttcggagacaatacagaaaggacaggagcagaaaattaagcatataattataataacataaaaatgtacatgctttggtagggtagattttaataagattttaataatattggtaaggagccaaattacagaataccctagaatgtggaatacaaaatctcagagacaaaataaaaactcatgaaaatataagagcactttaaaaaggtaataatctttaggataaagaaagccttttctcaacacaggtactgagcatgtttaataaaaattaaatgagattaaagagaaggggcacagccacacgctccccgccccgcggtgattaggaaggtgatgcttgtgtaggtgaaagcatggagccagggcacagaagagctccgaacaccaacagtgctgcagtaagctgtctccacgtgggtggaatttctcacaatccactcacgggataggaattaattttctctccagttgcagaggggccttgtacatgaactgcgttggcatgcggaggaggggcaacacatccatgttggggacccctcccatccacagccccagctgccaccacggcagggcatgggctttgggggcaacaaggagagacaggctgtctcctctaggaacaactcattattcagctaaacgaaatggaagagctccatgtgaccaacaaacccaaattgagccaaaacaacaggcgtccccaccccccagagggataatgtgccaccaccctgtgtgcagtgggagagcaggaatggaggaaatattcctggttcagttacactcctcgtctgtcaggacagatgtgccaccctatctcggattccgggagggtggctgggggtttccctcaactctgcagcaaacacttcaatgctactgtcatttgaggcctaattttcttccaagggcactatatgccatgcttcacttgggccagatgttcagatcagtgtgtctgctcgtccccattaagaacacaaccacaattatttatttgtccttccagcacatgtagcagtgaagagaggctgccggatcgcagcagatgacagacagctgatgctcctctgaagagccaccagcatcccagccagccaggacacaagaaggggaggcactctcgttctagccctgtgcaccaggccaccacaggctcccctattttaaaccctaaagcaatagttcaaacacatgtagattccatgtgacaagagagacagtaaggaagatttgaggctttatattctttagatgcctacttttgccatactggctagtaagaagttatgtgtaacttcaagatgaaaggcattagcaacctcttagaagacgataatcccaatcttctggagattgaatgagatgtaactcactgaagcttttgactcggtctgctgttaattgaatcaaagtcaatgacaatcttgctgcacttcggtatgaatttcctaaaaataaaaacaaaatacaattattatctggtgagtagtgaaagcaatttgtttactttggcttaactcatattttctgtgcagagaaaaatatgtcctgggattcacttgctattttctctctataggagccaattatagtgcaccataccaagagaaacacagagcagaaaagactaagacaaaaaaagatgcatggggtggtgtggtttgtatgttttcagctctctgagttcacgaattattggggagtcaaaggatttctaacaagtcagctgcacaacatgatatccgattactagttttcccatcagatttatcttattttctagaaaaatttctgcagccaacttggagtctctctaatgcaaaaaaatagtaaattttcttttgccgcttatatatagcaaaaaacgactacctttagtgaggagtaatttttcaaattacattctaaaaatgcaaacataaaccaacttttttttttttttttttgctcattaacttttcacttgttcctcatttcttctacaacaattaaaaagaagacatttgggaacaaaacaaattcttttaagaatcactgaacaagagagtatacaaataatttgaatttaaagtctcagaaggcaccacggttgagttcatgagatacactgagctgtatccctaatgaccagcacaaggggccagggcacgtcacctatgaccatggtcccactgctgctgaacgccaataccatgaagcgctggaaaactttacagtcccaaaggaattttctgccatgaatcaaaggtagttgaacttacttgcaagtaaaatatagctcacaaccatttcttagcaaagataatcataaaaatctgtaagacttcaaatctcaatgcaaaatgttgctgtaaaaagaatccccaggtggctcacacctgtaatcccagcactttgggaggctgaggcaggcagctcatgaggtcatcctggccaacatggtgaaaccccgtctctactgaaagtacaaaaaaattagctgggtgtggcaggggaggctgaggcaggagaaccgcttgaacctgagaagcggaggttgcagtgagccaggatcgcaccactgcactctagcctggtgacagagcgagactccgtctcaaaaaaaaaagagagaatccccaatgtttcaatctggcaggctactttcatcctaaattttctatgccaaagttgttacatttgcaaaattcaccaaggtttggcattcctattataaaacttgtgaatgtttaaacttctcagtacttgaataattagtctaattaccccggaaagttactgaaattaaagtacaatcattaaacaaatggtcttcagattttcctgtcactgctcttaaatatctacccctataatagtctttaaattcttatgcccttgcatttctaaagacacctccaagtgtggaagtcaggcatcacaaggaggagacaaggtcaaatacatctcttcatcagccttcaccctaccccgtccccccgcccgcattctccccacttaccggaatgtcaccccggccatattaaacaggagcctcgcagcagttgcctcgtcactatcatggtatttatcagacatgaaaatcacttcttttatacctgtaaggtaacaatgggagctcccttagtgtacgcacctacagatgctgcaaaagacaggcggaagcagctggagcactttcagcgtctatgattaatgaccttttctgagtgtgcttgcagacagtgtccagtcactgaaatacatatctgctgctttctaatacagcagagggtggattctatctaatcttccctccagtctttatggattttttttttaaacaaatgcaaagggaaaacatgtcaagtagtcaagccttgatccgattaaccaatttcccttactacaggtaatcaaggcagtatgcacaaggtagcttctcttactagtgggaggactaatggagggagtgggggctgctggcaaattcagaggtgggcaccactgtgcttcccagcatggctttgcagaccacttcaaaccagctctacagagggcagatctgttttcttgtcctgatctcagcaggcagcgctaactcggcagccaggaatcccaagggccccgcactgaaggccgctgctccatcagcctctgaaggcagaggaggctgcagtgtggggcccggactgctcggcccacaggcctgccaccgcctccacacctgggcaccgcgaggagagcttcccaggaacggtgacggcgacagccagggagcccacgcgactcctcagtaccagcaggccgcttctgctctgagatccacaggactggtgataaacggccccttcaaaccacacatttggctaaacatggtaagtctttaaatctccagccgagagttttatggagacaaagtgtagctgaatcttagatgtgacagtttgaaaaaggcgaaatattcagaatacaatggtgtagatttatgggaaccgtaaaataagaaaacctgaaggtagtgccatttgggtcttatgacatttatatgccaaggtatgttgagatcctcaaatatctaccatgtattagatacaaattaaaatttcatatacagactcccagctgaccttgtttctgacagaagttcatttcttccctcccccaaatctatgcacaatatgtcagagaacagtaaattgacagtaattatatgcaatgcctgtgttgttttttggcagcttgcagtttaagaagttgcaaactaaattaaaaacatgctaagaatcacagaggatgcaattagtcttagaatacctggcaccattcaaaaacaaaacacgggaaatatcttgcaaagctgatagtgcaattaatttagatctaaacaatagcaatttaagatcaaacacatcagcaatgagctactgacgagcaggcagcaatgcaaatgtgacaaatggaaagacccggttcctacctgcctggatgatgagcttagcgcattcattacaagggaacaaggcaacatacatactacagcctttcacatcggtcgaatttttgttcatgatggcattcagctccgcatggcacactgtgggttgaaagggaaagaaagaaaaactttggttgcagctcatgaagaatttactaagtgttaacacattccattcccccctctgaaataacatataacagactcaagtaaaaacattgattagaaatggcaagtcctaagaataccaaatgaggcccacgtggtctggctggttgctgatgagcagtgaggcctgaaggcacctagagcggccaggacggccgaggtcaagtgccttccccaccctaagcgcagctccgcttcacggctccacaagaccctggggcatgaaagtgcccacctgagctggctcattggtgtgctgacacgcacacatggggaagttcaccgtggctgttaagagggctaggggattttaagagcaagagaatcaacaagtgacgaagctgagcgtgtccatcctgagggatctgctttaccacatcgtgctcagcccacatacgcacaaggaaaaacgccagcagccagactgggtctcgttctgttgcccagagtgcagcggcatgatcatatctcactgcagcctcgagctcctgggctcaagtgatcctcccaactcagccttccaagtagctgggagtacagacgtgccaccaagcccagctaattttttgtatcttttgtagagatggagtctcactatgttgcccaggctggtcttgaaatcctggccgtaagtgatcttcccatcttggcctcccaaagctgtgggattacaggtgtgggccaccatgcccagcccagtctgtcttttataagaaaaacattcatccacttaaatggcaatgactagttgagctcttgatagaccagtgcattccacccatgatcccgggtcacatccggacctgcctgagttcagagtcaaggggatccccttcctccctctctcgaacctggcaaagccaacacacaccccagaggtccagtttgcctagatgctcccgctccctaatccacaggcgacatcctccttgagggggaatgagtggtgcccacagcacacacctgggtttgactccctcatcctgcccaggaggtttctggatggccgtcttgtatcgttactgaattttcctgggtgtgttatctaaaactctattataaatcctaacagccgtgacttgcaaacctctctgatatcagaacacccttaggcgcttccaaaatacagagatctgtgccctgtgcctgcagagtgtgatggcctgggctgtggcttgggcttgaatttgtaagcaattccccgggtgattccaacgtgcagacaagttccggaagcactgccttctggctcccctggtattcccagcacatgctatgcacacaagtgctaaaataaatatttgtcaaacgagttaatgaatgacatccggccatggcccacatcacacaagccacctagaatataaatatgggaatcttcaaggtctcccctaccctctccagcctgccaaccttctacacgtaacacttccaggagttctgaggccttaaatgagcagtggcctaaacttatggcgctcatacatttcagtcccgactcacttgcttcatcgatgatcatttactgagcacgtactctgggtcagagagatgaaggcctggccactctcctcagccaccctctcgtgttcgggtgcagctgcagctacctctgtgtgcctgggtcccccagcagcaatgcaatgttgcaggcataaggctgaccaaaagctctctcaggaaatgttaggaagtattcatttttgtctacaaattccatgttttaggagatctcagtcctgcctaaaactgagcaatctctcctggcattgcaggaaaatcaaaagaggcaaacaagctgtgcttcactgaccacagcccatcagagaatcatcttcgctgcccagagtgaccagagccatgccccgagacttgcaggtctcataaaccctgacggcatgggaggacaaggaaagacaagagaagggtgcgagggcccgggcttgggaaggcacaaggtatggccacatgtgcgctggccttggaggggctcccgtgacctcttctcccccttgtgaccaggctgctccagagctgggtttcacgctgcttggtgttaaaaacaattacatgtaattgtttcttttatttcccccttgagggcagagcccagcctaggttctttgtaactcccccagagtctaatgtgatgccatgaacataatgggtgttaaatatttatcgaatgaataaaggaggaaatgcagattccaattattgatggtgacgttcggaagtactggaagtcctcttaaattcaaatatcagaaatatgctctcccatctaataaatacttttggatggtgctggtattaatattcagaactgcagagcctctgcatctgttatgaaacactatgatagcgtcctctaagaactgtcacgctcactgccatgagcttcctctacttcatcccaggcagtttggggcaaaatttaacagtataggtctggattcattagtgaaaattaccatatgaaacagattctcttgggcagcatctgacatccctgtgtacagagggcgatttatagaaataatgcacagcattataaacagacttcctttcttttaaccaaaaaatcacaagatgaagaatgtaaagcttcttgttaaaaaatatatatatatgaatattaatattaaaaataaatattaaatatatatcatatctgaatattaataccagcaccatcaaaaagtatttattagatgggagagcatatttctgatatttgaatttaagaggactttcagtacttcccaacatcaccatgaataactggaatctgcatttcctcctttattcatttgataaatatttagcacccatatatatatatatatatttacatatatataaagctactgggcaatatgaacagtagtgtgtcgggtacacatgagactctaaaaggaacaatccaaaatcccacatacgcaaaagtggacactgacaagcaggaaactcaagtgttcggtggagggtgtaagatcagccccaccctggtctctcttgctggttcccgtacccttccccagaccccctcagccctgtcttatgatcacaggcttgcccgacccgcacctgcggggctgaggagagaagccccaacccagaggagcacctgaggccgcaacccagccctgcccccttcgtaactcccagctgccgcctgttgtggtcctgaaatccagcttcacctttgtggctgacactcgtctatcagctccaggatctccatagccctgaaactctgaaccttgctgtcccccaggccgccctgtacctccttttgggcctgtcctgaggagacaggactcagccaggcctcagcccccagactgtcctcagagaggaaactagggaaactaacttgatgacttcctccaatttgtttaaagcaggtgggtcagagtaaagtttggggattcatttacttgtgtcgactggccatcgacactgatcaaataacaggcacctgccaaatccacttcaggccacaaagagcactcgatgactgcctggcctgtgacgagctcatgcctgccctggctggccagaccaccacaggccaagcatcctcccctctgtactctccacctctgccagcgagtgtggacaaagagctttgcaacaagggcagcacgagggctcaaggtccaatttgctgcttggaagccggatgaccttcgacagggtggctgagcgctcttgtaatttgcaggagtgacagtggatctgagaaagtgcatttccagctaactaaataaaagcaatttaaaaaataccaagtacatccgatgtctttgcttttttcctaaggtttccagtttcattcctcaatcctccagaacaggtgactttctctaaaacaagctttcactatcaaaacacggcctcctctccccaggcaaacacaaggccgtgctcccagccccttcctccctccatctctgagggctcccgcttctctctgctcgtttttcttctcctgtaagcatgcatacttagtccttagtctagagaggtcatcttgtcagccttttaggattctttttttcctcctttcaagatgaaatcatcctatctacaattgttactataatttatttttaaaataattgtcttctgactttgtaaggcatacataatccccagttttctctaaaataatgtttttcaaactgcaggtcatgaaatcagttcaatgagttacaccagctttttcttctgttttaatgaaataggtaagaagggaaggatagaggtcagaatggatcccgcatacaaggttaaatactattcctaaaaattatgtttcaggtgtcaactgtgtttgctgggtcaccatatatctgccaatttccgtggtgtagacattttttcacacagccaatctcccactcccaacatgacgtgtacttgggaagcaatgcgcacagttggctctgatgacctgatgagagccagctccacaggccacaggagggtctcgtcatcatgaaaacccaaggtctcttctggcctggaaccttttgattcacctgctctctttggactcctctctattctaaaacctctcaggaccaccatacacttgtgttctctttctgctttacttttctgtaggtccttttatttttcctgcctttgtgggcacttcccaaggtaaaatattggtctttgatttttctcccatagtcactgcccttttttttctttttcttttttttttagatggagttttgctcttgttgtccaggctggagtgcaatgacgtgatctcggctcactgcaacctctgcctaccagtttcaagcgatgattctcctgcctcagcctcccgagtagctgggattacaggcacccgtcaccatgcccagctaattcttgtatttttagtagaaacagggtttcgctatgttggccaggctggtctggaactcctgacctcaggtgatccacctgcctcggcctccaaaagtgctgggattacaggcatgagccaccgcgcccggccagtcactgaccttaagaatccatctgttcatagattctcagatgccagatccatctgtaaaacctgaaatctggtgtctagccataactgcccatcttctccccaggccttttcttttgggtggtctggggcttccatgtacctttcctctatgggttaaatatctcttatccaaaatgcttaggagcagaattgtttcagatttcagattttaaaatgtttgcattatacttaccaggtgagcatcccaaatccaaacatttgaaatccagagtgctccatgagcatttccttcaagtgtcatgctggtgtgcaaaaggtttcagattttgggccaggtgcagtagttcatgcctgtaatcccagcactttgggaggccaagtgggggagatcgtttgagctcaagagttcaagaacagcttaggcaacatagtgacagctcatctctactgaaaataaaaaaacttagccaggtatggtggcgtgcacctgtagtcctagctacttgggaggctgaggtgggaggactgcttgagcccaggaggtcaaggctgcagtgagctgtgtttgcaccactgtactccagtctgggcaacagagcaagaccccatctcagaaaaaaaaaaaagtttcagattttgatttttggatttggcatgctcaacctgtacaataaacattccacagatatttgacagcaataaatgaaggaataaatttacctttccctagagtgcacatttttgttgtgttgcctggatgaactgcagcaagagctacaactaaccaaaactaaccaagaagtaattgttagtttttatattcgtagtaggaataaggatcaagtatttcaaagatacagtgtctaggaagtattcataagttagtctaaattgtaaaaaaaaaaagaaaaaaagataaaatgttcaacctagaattacacatctacagctaagcaataagcaaaataaatctgcaaacagtacatatatatttgataagcacaaagagtgacacacaaccctccagttattcccaaccttgtttaaaaggaaaagaatcaaatgctgaaaatatcagattaatgcttagaaggccttgattgccagaagagactttctgtttcaggtaattataagacaattcatatgctttggttttttttttttttcttttctattactaactgtcagaattcagaactgcattaaccttggaccatggagaagagactgtataattagaaaactgtatttttcaaattctctcttagtagggcttgattaatccttactgtctcatgtaggcggttctctagaagtttgacaaattaacaggatatattccatccctggttagatttaagagttcagcgttttatagatgtgactttcacctcatctgatataagactgatacaatatctattttagacggtagtattataaggttactcagataggtttgtttaaaaaccctaaataatgctgaacaaattctaattgctgcctaaataatttagcagtgatagtgttattctaccctcaactgatcttcatctgctatggagatgtgacaggaactactggggcctgagaaaatttggagtcaggaaaatgaaggttctgatctagttctgaactctagttctagttctgaactctccaggttgcttaaaaatccctcatttttagtgacacaggattttccttaaagaaaacgatgtccttagacctgagggttgttctgccaaagctgacctgaacaggtggcagcctggtgtggtggctcccgctaggaccggggtcagaaggccaggcatggagtgcctgctgccactgagaacagacctgcaacgccttctgccgccaccccaggctgagccgttcagagcacggacagttctgttcactgacaagacaagggtcaggactcgagctaagaagcgtctgctcatggccttctggaatgaaaaggtgggaagcatcaccctctattatttctactgggttcccaccctgcaattaacaagtgacatgaaatggcatacccaagttcaaggttgacctgtgcattaaaaaaaaaaaaaaaaactcagtaatttacaggattttctacttccattctgatgacaaagctttttgtcatttcttcctgaagttagggcctgagtgcttttacttctggggtcctatagttatcagagttgctaaacctggacatgttgtctctgggagcacctgcacccctgccccggcccccactgcccacagatgcctgatggaaacttccgctgagggatggggtacacacttactcctctaactgatccatttatggaactgcttcacagcttctggaactaaaatggaatttcaactacttgtttcttaattattgaaagatatcctgacagggcctcatatgtcactgccagcctccgcagtccctatcctgcacgtcaataatttaacaacggaatagccgcgacagttaagccccccacaacccccaccaagtacactctcccaaaagcttatgaagtgttcccaattatggcttccccaaaatctaaagcaaagatttctagaatttggtcccaaataatgtcacctctctatcttatctctcctgcatgaagttcctattagtaaagcagcaatctggctcattatcaaggttttcaaatgatttgaaataaaggtggaactggggaagggagcaccatatagaaatcaacagatatcacttctctaagatagttccaccagacaagcccctcttgctccccgcccctctcctggctaaggccctgtcttcctcctgccagcctgctggactgctccaaagcctatgtccctctaagcctgctcagacagagccctgtcccccacccaggggagcagcccttagtaacaggactggagcaagaaaataaaacagtttaaaactttcgcagtttcccaggtatgttctggtaagttctggttgcaaactggcctgcactgggtggagagctaacagggctgggtgtgtgggctgcgggatggaggtgggtctggtccctgcagagctcacaccagctgggctgcgatgccccagcatggaaatcagcagcggcccgagtgcaagctaaagcaacacagtaggactgctgaaggagtgctgagaaaatccagaaaacgagggttctaggcactgctcgcaggtgcaaggggaactgaatcttcaagtaacattgtttctgtagaaaaatgtatgtggattacaaatgttttttcaggacaaagggatttaaatcctaggatgtgcctacacaaaggtaataccctgttcaagttccagcctctctcagctacgaataggaataacgacacccgccccttcccatctcacagggtcacacgaacagcaagtgagggacacagtaggaaaatgctgtgtgaactccaaagaactctgcaaatggggactttgtcaccagtactcagaacaggacctgtttcctaagaaagacactggctggcaggaaccaggtcttcctgatcagagacaacaagtgacagcgcttctgcctccccgatcacgctgcacccgacagcctacctgtccttggcatccagacactcctgcccccagcccagccccaggcagagtgtggcctttctactcagaagataaagtaactgagccctcccgccatggagggacacatgattccacctgataggcatgacagtgtaagtgtgtgtgtgaaaataaagacgagaaacgggggtgatgtggagaaacccgccgcatgcgtggaaaatgtgtgggctctgttctgtttccaccctgtgcccagagaggagggctctgctagaagaaaatgacagcgcaaaggaattctaccaaggtctggggagaaagtggtgggtcactcacgtaaaaggcagcccatcctgcaggctctgagggaagcctccacacccagggtgcccatccgcctgcccacagcccagggccctgaaagctgaggcaagaacttccgtctccgctcctgcaacaatgcactcaggggtcttggagacccctggttctgcctgtcttctctgcttcctccctaccatgtcctcacacactgtccacaacctaccagtcaagcatcttcttcagcctcagcctccggacctaagaaatagagagaaaagtccctctccaagaacggttagaaagactaacatctgtcaagagcacagcacagacaagctacttgctacatgtgagtgcttcccatcctctcccacgtgtgcccacctgagaccaggctgtcctggcctgcccaatccagcctgcctgtgagaatacccatttctttttccctctctcccactctgctccccatccctgcccccttcctcaatgcctcttgctaaagctgcggatgacaactcacggcacccaggggagccacttagccccaatggtagtgctcagggctaaagagatttctgactgtggtaaggccattattggtaataaagcccccagaactctaattacactgcctccctatgggctaagggcacacaatcaggtcaggaggaggaggatgtggaaatagctgtactgcatccacggtaggccatgccaactcccttcccactgttcatgtgaaatgcacacgtgatgcctaaaatgcgtgacaacagcaccaagagaaacagagcgctaatcagcgctgatagtactgtgatggagcttaaaagcctcctttgtgtgttaatagcgtttagaggggaaccgggcctgagcactgggcactggaagaggagctgggatgtgtgttctaattaattccagctctccctggcctgcctcaggcagcgcactgatcctgggtctgcaggtagaaaatgggaagcaaccgcccaactcgagattctcagataagatgtgagctcctgacactgccctacattcctaggacattcttctcccaccccacacaatcagctcttctcttctcccggcatccaagctccaactcccagctctctcaaccgatgaccctgcttcctccaccggaatggtgcaactgatcacactctgcctttcgctccaggaccctgtgtctgctgtcctcccacctcccctctcagtccttcctcttattatcaaccagggtgtctgagagaccgatcctcacagccttgagcaccttgcctctgttccagaaatctctatctcactctctctgtcttggactattcccatcaacaaacaaatgtctgctacagaaaagcaaaaaccaaagccaaaaccagattctcctatcctacaaacaatgcaatcctttcccgtggccttatctccattccagccaccaccccacttctctgctctcttctcagccacacatcccaaagcccgatctaaataaagctgtccccattgtctcaccctctgttctccttcaagaggctccaatgtggcttgcaaccctattgctccgctgaaactgtacttggctgaaactgtacttggcaatatcacctctgacctccacgttgctgaaccccatgaacacttttaatcttaggcctcttggcagcctccgatacagctgacaagcccgccttcttttttttttttttttttttttagacaaagtctcactctgttgccaggctggagtgcaatggcgcgatctcggctcactgcaacctccgcctcccagtttcaagcaattctcctgcctcagcctcccaagtagctgggactacaggcacgcaccaacacgcccagctaatttttgtatttttagtagagacggggtttcaccatgttggccaggatggtctcgatctcttgacctcatgatctccccgcctcggcctcccaaaatgaggccttctttcttaaagcactgctctgtgtgctccttctcacgggcccttctttctccaaccaccttaagcgctggagccctcagggctcagccacagctactcctactgcctctgcacatgctcccttcatcagccacccaggtcgctggcactgacatacctgtactgctacagccagtcgggactaatccccaactcatacacccacctgaccacccaaccctttgcagggagcgctcatgggcacctcagccttcaggtgtctaaatcttccttgatcattccaaaatcttgcttctcctcctcagcatgcctgtctagctactgcaaccagaaccatttggggggagtcaatctacctcttccaccctttatcacgccatcttcctgatgctgcccctaaaatacaccccatctccagccaggcctctccagccccagcacccaccccctccaaggccctcgcatcgtacaccacgtcacctcccggctggcgagtcgctgtttccactcttgccccagaacaatccagttcatacacacaacctgtcctagtttgtttgggctgctctaacaaatatcataaatttgtagcttctaaacatcagaaatgtatttctcacagctctggaggctgggacgtccgagatcaaggggctggcagattcggggtctggtccctatctcattaaaaaagaaaaaaaaagtgactgcctcagaaaggaatattcaatcatatctgtttgtttcattaatgtctacctcctccacaattagtctgcaaactcttcaaaaacagagaccctcccatggcattctgttgacctctgcagagtgcccggcatgtaaaacacataataaatgccctagaagtgtctgctgaatgaacaaatgaccacatgtgatggtgtctgaaaaactccaacgcattataaaatagagttaggattttaaaaagaaagaaagatgactccagagatcatccccatcaccagcagacaactgaaactggtaagagaacaggtgactcgttagtacttattttaattcctaaaaagtgataactcacatggagaaggaaaaatgacagaagaattctgcttccctttattcacctaaactcaaaattaatggcattttgaacaaagtcttttaattgcagaattaaaaaattcatgctcagttatcatattcaatattttaaatttactatggcatctatcatttgaaagaagcacagagaaaatttacacctccactaattggttggcaccgacccttcagacagcatcagcaaggggagcgcccattcccttgcattgcaactctcttgccttcaccagtatcctgcatttatcacagggatttcccaatgtcaagcaagtatctctgtttgaataaatattgtcatgctgacttgttctctaaagaatttctaaagtcctttctttctatttggtcttaacctcttgtctctttcaaagagttttcagcgtgtcccatgtaatcatacattttctttcacttagacataggatctttttcttaatttttttgagacagggtctctcattctgtcgtctgggatggagttcagtggtgcaatcttggctcactgctgccttggcctcccgagctcaagcaatcctcccacctcagcctccctggagtagctggggctacagctgcacgccacaacacccggctaatttttgtattttctgtagagacgggatttcgccatgttgcccaggctggtcttgaactcttgaactcgaacgatccacctgcctcggcttcccaacgtgctgggattacaggcgtgcactccatactcagctaggatctttttctttattgctgttatccaaccttttctcatccaatgtcttttaatctgcatgtctgtggagtaacctacagtctgactgtcccctcctattcatgcatcctatctccatatggtctatattcatcttagaactgcgccagtctttaatcgttagaggagggagggaaaggcgcctgtttctattaatttatccatatgtacacatgcacattctccctgtggcattgcctccaacagctttttacagctctgatttgaccgagaacgctttcagaactccgtaagctgagaaaaagatactaatctaatgccatcaaagctataatacttatatttttccttggaataagagaactggaagaatcttcagtgataatttacttcatagagatattgagaaataaatgtcaggtgatgcctctaacagccccacagtcactgggcatgaacataccaaacctggaacccttggctccttacggcggctccaggattctttcgtgtgaatatggcaattgttgttttaagcactatggggctttacttagctaatgtgtgtattacagacatgcatatccctatccagattaaaaaaaaaaaagtcttcaggaagtaaaagtaaaaagcaatacaaacatttgcaaaaatctctaagaactaggttttattgtgtatttctgggagcaaacaatatattcatattctactttaatatagctggtattaacaaaactcctgaagggagattccggattaaaaaaaactcaaaatacaataaagctttagtcatttcagccaatttcagagaagatcagtcaaaatcagcacaactgacatagaacagatcaccagaatcaagactatgagagtaatcattctcaggtaaccacactgtacagcaatccctgtgtttctaagcaaagacttagcaaagttaaagaaataaagaagtggccgggcacagtgactcaagcctgtaatcccaggactttgggaggctgaggcgggtggatcacctgaggtcaggagtttgagaccagcctggccaacatggtgaaaccccatctctactaaaaatacaaaaattaaccaggcgtggtggcacgtgcctgtaatcacacagctactccgaggctgaagcaggagaatcgcttgaaacctggaggtggaggctgcagtgagccaagattgtgccactgcactccagcctgggtgacagagcaagactctgtctcaaaaaaaaaaaaaaaaaaaaaaagaagaagaagaagaagaagaaataaagaaggaatatccatttgcattcagatcattaatgtgctcaaatacttaacatagctgttttctaaattagtttgcatgtgcccctgacattttatcaaggctactaatttttcaacaaaccttttatcttgagagattacagtacaaagataaacttcagcccacttctgggaaccctggaaccactactttagattaagttttatttcaaacttctacgaggtgaactgactcaaaagtcactttttatagaaaggagacagatatgtgtattttcatgggtaggtccaatccccaaacatttcagcttttcctaacatgtgtgctcttcaaaacaaggagttattttgttactatatgtctttcatagatattcataatgaaatagtaaactctagcactttaaaaataattaactctgtaactataaaaatacataaatatcaaaataaattatattaaaatatcattatttattcctttctgaaaactgtttataaacaattatatcttaaagtaaaacatgcttacatggagctggttgattttagtgggtgggagaagactcatatatacactggtgtgtccctctgtttatctgaaaccccacacgatcacagctgagtttgccccttgattcgtaaaaataatctacttaatttcttttctatgcagttgttcaaaggttttccattgattataacagtagttttgtacaaaagtccctaattagacctgctgtcgggccacaactagtagaaggccaggcaggggaggagcggcaggaagctttaagtgaaattaaattctgcaggaaaagaaacagcaagttatcaaattcatggactgactaacgaaaccagaggacattcaatttcaggacggaaagaacaaatttgatcttaattactaagaagctcttacaagttgtgaggaagtcatatcttaagaaggatcagcctcctaacttcttgataaattagtttctcaacactaacctttcagatgccaaagaaatatatcacgtgcatggcagtcaggaaaatgtcagtgttcaagggggtaaagtaaatggctaagtaatcacaaaagtgacatctatgcatgcttaacaatatgctaagtctgaaaaataaagatgaaatttaaatagagaatttaaagaggcactgccccacactggcaaaggtgtttaagatgctctgctgaactctttcgccttaattaattccaggtttttcagcattttccttcccagcattacatcctttttagagtatccctgtagacataggaactgactcgggtaagagccccacttctacccaacgcactcagagtgaggcctcccccgactcttggggacactgagatgctacggttccctccctggtgcagtgagatgcagcaggccaagcaaccctggctccctggtccattgggtgggataggaggccaagcacagaggcactcaccaaaacccagagccctttgccagcagaaatcagcaaggccacaagtgctgggcagctggatacatgtggcaagcattactaaaaattcccttaagtttaacaacgggaacaagttaattctccaactctctaatttgtaaactatatcatcaaaatcggttacgaaaacccaaggaaagagtgatatctgaatcaccaagagtattttacctcatttgataacattggtattttgattaaatgtgcttcactataatgaattccacaaagaaaaaggaatgaaaaatgtcaactgaatacttcatcacaggtttagcaacccaccccctcatgaaaataaaaatcttcccaagttttttaatcttgtaaattagataaatctgctgcttcctcttttttaattgtcattcatctgaaaagattcttagtataataacattgccttcttcctgccacttaatgttactgacatcatattatcttttggatttttcaggaaaaggatggaataaaaagcttctttagcagagggaattttcattttccacattaatactacattataataaaatagttttatgaagttttgatcccaagactggaagaacaaaaacaccctttaaaaataactctctagagacacagcccaggaaaagctccatcttcctattatgttacaagtagtgtgtgtttccctcctccccacaaggcatcaatcaggactaatgacttccgacttacggaattaataaagcagtattaagctgtatgttatttggtaaactcaaatttacacagttctcaagctccctgtcacagtcccttggggctgctataacaaagtcccatagactgggtggctgagaaacaatggacatttatttctcatggttctggaggctggaagtcaggacaccagcatggttagattctggcaaggtctcctttcagggttgcagatagccatcttctccgcctatccttgcacatggaaaaagagtaactgagctccctggggtcccttttagaagggcactaatcccattcaggagagctccaccctcatggcctaattacgtccccccaggccccacctccaaatatcagcacattggaattagggtttcaacatgtgaatttggggggagacacattcagtccactgcactcccctttgaagaaatgttacagtgagccacgcatgtggctttctgcatgatgccggacacaggccacccctccccgagctcctgatctctgaggagtaattattttatcggagcctcagtctgatcaactgcaaaaaaaaatgagacaatgattggcatttcagtacagctgaattcatgtgccccacaggagagacacagggaggtagcaggaagagcactgaccttggaattaggagatgtcaccctgcatgtgtgacattatagaagttacttacaagaaaggaggaggcttagatcctgtgggcatagaaccctgagacactactaaggtattgcaaggggtccaagcatatccacaactggataaatcccatgtccaggacatacataaacttttcccaaacatacataaatgctatccaattaataaagttcagattaacaaaaaatgttactgatacgaagtagtttttgtcattgtggagtttcttactcaaaagatactaagaatttagcattatgcaggggtcctggaagtttttcagcatttaaaagagggtcctgtacattcaaaagagttaaaaatcattgtccagaactcgagataatctctaaagctcctttacagggattaacctatgaatttacccttcctgctacagcagctcagtcaccattaatgtagatgaggaaagaatgggttgagctatccaactccaggcagtatccccttattttttaaattaattttgaaaatcttaaaacgaaagcaaaaaaaaaaaaaaagactttgcatttgagtcaattatcagcaaacatttctgtgacatcccaggcaatccaaacatttacttctctgtggcctgaaaaaccttgagaagacaacaagtgtacagtttatacacagtcatcgtcatttagactttaagcccatctttactgtattatggcggcagtaatactaaatgccttttagaaaccatttaataccttctacaacttttatggtacatcaaattacaagcttactctcgtgaaagaaaactgtcgacattctaacacagctacatataaatgaataattgataagtaagagcaaagagctttgaaaacctagaggtatcatatggataataaaaaataatgcagacagacaaccagtgcccaggagctcaggagctattcaataaaaaacaatcggtgaagttggacaaatacctatgcaggtttttaaaaaaattccttctagaaaggggctctgaaaggtactctcctcaatttggacaaaaggcagtgtctcataaccaacaaaatcagctacacgggaagtcaggagagctgggaagtctggggtgtggggcaggtgctgcaaatgtactgcatggcccttggcttccaggtcactgcttaaagatctgctgggggctctgggtgactgaagaaggcacaggccccattgggaggcccactcagtgctcacccaggacccctccgcactgtccaaccacgggtatcttttgcaccagcttgagtatgacggaccgccatccccccagaattcctccatatcaaagtccagccccagggccaatatttcactgcccagactcggtgacatactgactgtggccgtcacacagttcaatgcagacctttaacatatcgaccctccactttcaccatttttataggggactttgaaccgcactgtgaaaaattatctttgcatggacttaaaaacaactaatcacttcccttctttcttaccatcaaaagcttatagaatcaaaatcagggtgacagtttctgagtccgcgcatttttctaattagtcatccactaccaccggctctgaagctgtgctgagaagacagtcttaccctcccccaactccatcctctcttcccactccgacgagggagggtgaggttaaatcaaggatctgaggattcggtccccttcatccctaaactacttttcacatcctggaaacccagactgctttgcagtcctcagttcctcctctctctccaggtacctcttaactttttctttcaaacatggagaagttgcccctaggcaatttagaaagaaatttatggggcttatttaacatgattgaggtccaggaacattagtaaaaatatataaattagactaaatgttgacttggattcttcatgagaaaaacccagaagaaaacctaccaggagagtcaacaaagaagaaaggtcgtacatcacgccttggcctgaagacacaatctttcccatttggatggccttactctcccttcacttccaacagcgccagtctgttcattctcagacataaaatacagggcctaaccttacaaaaatcagcaacctgcatacccagcatgatttgcctcttttccagcattgcttgcatattctccaaggaatgcaaggaaaagtaaagctatggctggaccctcccaggcaatctctgaaggaattttccctggggcttagacaggcaacaaactctaagaagcagccttccctaatttcaaggggaaaatccagagacagtcaagccaaaggtttacagttctacacttctagctttttcttttctttgtttttgttttgttttttgtttgtttgtttttgttttgttttttgagacagagtcttgctctgtcacccaggctggagtgcagtggcgcagtcttggctcactacaacctccacctcctgagttcaagcgattctccttcctcagcctcccgagtagctgagattacaggcacctgccaccacgcacagctaatttttgtatttttagtagagatggggtttcaccatgttggctaggctggtctcgaactcctgacctcaggtgatctgcccgtctccacctcccaaagtgttgggattacaggcgtgagccatcgtgcccagcctcacttctggcttttggtctgaccacagcctactgtgaaattgcagcatcccctgtaactggaggaagcaactggatcctccatctcctgatgtctagttcacagtttgattcctgcttgccagcaatgagcttgagccagatgttctcatcaggcacatgggctgaatgaagcctgcttctcatcagaccaaagcccgagccagcccctggttagccgaccctgcttccaagtagtaaaaaaaggaacccacagagacaccatgcacatccctcagctatctctgcaaggggctgtgaccctctgcagagacgccgactatcagtgcactggtgtggtgcaggccagcaggttgccagtgaagcctgccaggctcagcacaggcagcagagccctggatctcagggccagcctgtgtggccactaccatgcttctctccgtggctctctttggaacttaagagacaaggccaggaaattggggtagttcagtaggatacttttctttccagttgttgatgacaaaagggagatgatgccttctgaccaactttcttaattaggcactcaccaggctatgtcactaagcagaatgggacataaaacttgccctaccgtacgggtatttggtgtccagcttattctctgctgtccttctccaaggcaacacgtcatcactgcacccatttggcatcccattgtacccaatcccgacaatcttgttttctgaattcacgatgcaggcgccgacctagaaggaaacatgcccaaaggcttggtgcctgcaactggctggtctgccgctgtggaagcagggaataaaaccagggggactgcagaactcaaaacagacgcatagctgctgcaggtgctgagagctgtcggtctccttgcctggttttttgtggcagcacccacaagccaaggaaagtgcacccccagtcccagaaggggcacaagaggcagttaacaatggcatgtgacaattttctgtctcacaggaagaactaagcttgtagaaacgcagcacaaaaggcagaccgaccctgcacttttaagttgacaggcgtccactgagtctcccctttctgctcatgtgcagtaatctctttgcctgtgagtatctaagcattctcccgtgaaattcatttacctgggaatttggatctttgcttctctgtgctgataagaaggccacagccataaaatactctggccattccaaatagtcgtcccgtttcttgcaggaaacttcactcatgttgggtctagaagaaaaacatgacaaaacagaagttgagagaagcattttagtaagtctgttttccagttcaacccaaccacactgaacctttaaatctctaaacatgggcaacttcagctacatttatcaatcagaaatcacagcacatgggccctaaacagtctctggtcttaagtaaaaacttaagaaatttcctatttcagaagtttgaatttgaaacctatagcttcacgttcccaaatatttcatctatttactgctttctcataggattttttatgccagcctacaaattgttgtgtcctttacctgtctcccttacaaagcggagtcagcacaggaggagggtggaaaaaagaaatatttattgatcatctatagattccagacattgttaaagtttatacacatcatgtcactcaagccttactcctagctaaggtagacagtgccatcccatcttacacagactcagagaacttaggtaacttaacctaaaccacacaggattatcatccatgccagacggattcaaagaaaacatctgaagccttcccaactctgatattaaccagataatttttcccttccctttctcctcaataatccagatgggacagaagttatcaactccgagtaatgaattacatgagaagaaactatgaaaaacgtcaagtgctactcctaaagcaaggtttttggaacgtagtttaccaggggcaagcagagactgtctacggcagggagagcccacgaagggggtcctaggacttcaggggagtggtcgctttcaaaaggaatgaaacaagggcaaggaaggaagacaacacaaaaacggggtgggtaccacggagaaatcttgagaaaggcgaggaatgtggtctaaaggaaggcaagcatctcccaaaacttctgcttcaggctccacactttatttaggcatctgctacagtgcagggcggcagtgcctaagacaaggatgcagtggagagtgggtgctgggaaccacggtcacccactgattacgctgccccacatctgagaggcctggcaacccccctaacaggaaaagacaggtgctgaatcagcctggtttcccacctggctttagggccagcatccatcatcgctgtggggtgctggagaagtacctactaaataggagggagggggagccatggggggcgagggaagagcaggagagggaagggtcctgttaatcccctgggcgccttctcctggtgtggctgaacgcccactagagccctgtgaggactgaggcccagctgtagaaacagagagaactggagctcgaatacaacgattcaggaagacacatccggtcaccgtcccaggcacaccccacgccgctcgcaaccccgtcagctctgatccagggcctacacccggcattcccaacccacacacgggcgcaggaagggatgtggtgttcagacgcccagcaccacctcccggggcactccaaggggcccggcctcgcacaggccgcggcgcccgccgagaaatcgaccctggagtgactgcggggaccccgagcgcccccaccccgcccgcattctccgatctaaaggctgagcgcggccgaggcgcccccagcgtccgcggccccaggcccccgcccggcagccagcgccccgcgccacgcgctcgggacggtgccacgcggcggtggctaggggcgcgcgggccgcgtacccgcacggctggcccccgcccaccatccggtgccggctccgcgcgcaggccggtgctcgtccccgccgccgccgtgctcagggaaggaagtcgggggaggaggcggggccgccgcggggccggaagggggcagcggcccgggcgccgcgcgttcgcaggacggcggctggccccgggggcccgaagccctgaggggagggagggagggacggcgggggcgggtcgcacgccgcaaaggcgctgctccgcgtcgccgtacgcctcccggtccccgtgacgcagcccgcggtccggccggcggtgttcagagcccgagcacaaactacttcccgggtgccagaccgccccgaggtcgccccgctgcccgggtcacgcgtggcgctgggtggccgcgagttgggcgctcccgggcctgactgcacgaccgtcgggggctgcttggtttggtggtggtggcggtggtgaggttttccccaccatccgtgttccatcaactgcttagagacacggctatggagattgtgattaaaagacgaccccaagaatctagtgccgtgaaactggcggggcgggaggtggggagacctggtttgggtctctggagtgagcccgctgtgtcgcagcgtccccgtggggacccttggccggtggctgggtcacagtttcacacactggatggggcagggaactgggtccggcgggggcgctgtgcctcgaggctcagtgcctcgaagctagatttgcatttggctgcgcctgacaggctttcagtttctgctcaaattgtgcggaagggcctgaggtgtttgctaaagcctgccgcgccctgctcgacccgtatcaccgcacaggcaccccacctgcatgttacctcctggtaatgctcgcccacttatatagtgcacattttgttgcagttgtttcaaagatgagaaaaacagggcaataggaaagaccatcagtgacatttctggagtcgtatgccccaagcaacttaatctggttttcatgaacttcgttaccctgtgcagacgtctagccccttacagtggttctagcacagagaatgacagaagaacccctttctgtttcattcatgggacttgaggggactgtcagcactccataaataacagctactgtaataatcgccagttctgatctgcacatcccagatttgaactgctattccaaacaaaagcttgttaactatattaatttagcctaacggaggaagaatgatgagagtaaacagttggttctatctaatttctcactacagcagacacatcattcttcatctcatggtccagcttgtagattcaataattaaattatgtactgctcttggtggatgccgggaaagcaaaagggagaaatacttcatcgttaactatagatttttttttttttttttttgccttgataagactcaggcttgaaagagccacatagattaagatgatgatttttaatttcaagttgactttacatggctgtcttgttgccgctaaaatgtgtcatatatcccgagcccctggtttccctcctcctcccaaatccaccgcttggtctttgtcacactcatctacagtctttgggtcttcatagatccatttctcttcttaccaacctacaacccatacatcaccaattgctgctgctccttcaaccacaacatcattaagctttcttccttcctctgctcggtaaagactgtcatacataatttagttacttctcatcactctccattttggtcaactcacacactcccctctgccataaattcaagctcctgcttgctgaaaacacattaccctgaatgttcccgcatttcactgaaagtccctcatcttaaagatgacatcattcataatacaggaaaccctcctggttcagagtttcacaacttgaggtttcaaatattgtacaccaatagtgaagccacgcggccaaaggggggagaaatatattccttggtatgtctttctcattaacaccttgtaactccaagtgtgactgtaggtgttaaatctctcttgctaataccttgtatttgggcttataattgaggatctttctccacctactacagatacagaggttaggtatgtgttcagccctatctagattggccttccttgagggcctcacacaggttgaacccaatcagcacattcctaaggactactgtcttggcccttttgtttatggggtttcgtgctatctatgtctagtctagagcataacctggaatatattaatatttcagtgtgccttaggtaggggatcccgattaaaaacagaagtcaaggtaagactcttccagggctgcctcagaagaggggttgatggcatttgcaaatgtctgccgtaccgagatactacctgcccctccttccacctcctctgcctgccaaggtaaggatgagacctgtgactggggaaacagaggcaaggagtcaggaaggtggccaatctgtccatcaagtttgtcatgagagaaagagcaccggccttggagtcagaccagactttgaaccctactcccacttcttacaacccgagtaaccttgagaagctacttccattcttggagtctctgtaaaatcaacaatattcattttttattaattccctgctatgtgctaagtgctgtaaataccatgatggatactataagccagttcttgccctcacattcccctctccgcaaataaacacagaaaaaaatgaaccttattgctggcccagtgaacatagtaaatgttgttataaactgcctgttgttcttaatttggtggttgtcagtcaggaccaaaaactcctttgcataacaactgcacttagaggcaaagtgccactttgactggttttcaaaggaataattgtttatgtttccatgctaaagtgcaaactagagaaaactctttttaaatcttaagtaagggatgactgtaagtctgctaaaccacaaaaaagtcacaatgaaaattctagaaaaaaataaatatgtggtcttatcaatacagtacaggttgagcatccctaacctgaaaattcaaaatccaaaatgctctaagatctgaaactttttgagtgctgacactcccacaagtgggaaattcacacctgacctcatgtgataggtgcacaaaattatgaaaaatatcctgtcaaactacttccaggctatgtatgtaaggtgtatattaaacataaatatatattgtgtttagatttgggtcccatccccaggacacctcattacatatatgcacatattcccaaatctgaaaaaatccaaaacctgaaacacttctggtcctaagcattttggagaagggatattcaacctgtatatacattttcgtatgtatgttagagcatgaggtcagttgtttgtgttccatgaagggcatacagactgcaaattgacatgacagagcactcctatcagaaaaaaaatcaggatccctaaacagcgtttttgttatgagttgaagccaccaattactttgtcattatacatcttcaaaattacaatgaagggccgggtttgttgtaatgaactcactcctgtaatcccagcaaagtggcaggccaaggtgggaggatcgcttgagcccaggaatttgagaccagcctgggctatgcaagacccagtctctgcaaaaaaaaaaaaaaaaaaaagttttaaatgagccaagcatggtggtgcatgcctgtagtcccagctgctcaggaggctgaggagggaagattgctcgagcctagaaggttgaggctgtagtgagctgtgactgcaccactgcactccagcttgagtgacagagggagaccccatctcaaaaaaaaaaaaatcttttttttcaatgaagatcaataaggaaatgttaacatggcatatgcacaaagctgggtgttttgccgttttttattaataaatatttgttgactaaataaatgagttaatagaaaatcattgttctatgccaaattgtttggagcatctaactcatagagagaagtctttgtctgtgaactctggttctacttccctatccgcctcctttttctccttgcaattcatagacctggagagacatttgataagtgagacattggggctggtgggtcagggaaacaagagtgaacagtatcattttaaggaggcatggatctcagtcctaggatttggggcttggcctgaaaatgaccatctctcgtacagcagagctgaaggcggaggggaaggctgtctcctctttcctggtgtgatgcctctccccatgacttctttgcttctacagagctgaacttgtagcctctttcatacacaactggttgaagtggatggaaattacatgtcttattgcttcttaaaagaaaaaaaaacatattaaatctaaaagaaatgggcaattttctcgtaccactttctatttctgtgtaagttaccaagtgccaatcattcttactttttaaaattcacatttgtcaagcagcatgtaagctttcagtgttgtacaagaaaagataatgcttcatgtggaacagtcacttacgctattctgtgaaagtgcctaacctgaagagaatgtatcagattgttggctttatagaaatgttaatgatttcattaaattacaccctctacgctggggtcaccaaggaacctcctaaagggtaatcaacaaggtattacggttctggatatagaattctttattgacatcagagtcaccactcattttgcagtgtgtattttaactggtgtagcaaggtgaatgcctaagaaccattgtaaatgaaagtccctgtgaaattgtagttgggagctaatggccatcataacctgcctgacgtgttgcgccttccctcagctaactggaaagctcactgggtgtgaacctctgaaaggagaaggcgcgaatcaaattaacattttagtattgtggcacaccatgtatgtgtatattgaagataacacctgtgatcctaccacaacaacaatctgttgttaatgccatgagggaaaaagtcatcttccacagtcaggagcaaacaaaataagggaggaaccctatcctatgtgaatgactgttgacactgttcacagtaagcaattcaaagctttgattcaagagctgacagagagcaacaaggcagtaccgaggccagagttctccaaaggccccatttctgatgaacctctgtctgctgcagtgtttgatagacaacttgaagtgatacaaggtagggagctctcagccatgaagcatgatcctagtaatgctatcttcaaattagccctggattgagttaaatatcaaccaaagggagtggaacggccctcatgaaatcatccctaagagaatgagagagatctaatagtgtggtggttacagtaaccactaacctgcaagaaaaatcgatatctacactgtgttagaatcacaccaagggctcctggagccgagccatttcagtgaagaataaaccaggattcattagagtagaaagtcagaatgtggtaggaggtcaaacataaatacaccccgggctgtttcgtctgcaaacccaagaagatggtcttctttcaggatccgagcattttttaaaagcatggaatttacagagctgggaagtgaccttagcaatcattgagtccagccccttctttttacagatgaggaaatagtggcccagaaagatgacttggctcgctcccattcacacggctgctctggtgagatttcctcatgccacactgctcatgtccagctttgcagtccatgaatcaaaacacaactgtttattgagcctctctgtggaaggcactctgccaagctttcgaggggcgtaaagaaagccgcatcagtcttctccctctctttgccggagagaagatcaaactacataataggttacccaagattcagtggttaagtggcgatgtaagacaacaataaaagagagctgtcccaaagcagaatatgattgtgtgtgtgtgtgtgtgtgtgtgtgtgtgtgtgtgtcttctacctaaaaaagccccttcttcccacctaggaagtaggttataaaggcaggggttttcctgttccctttattattacttccacttagcacaatattcagttgtgtttataccccagtttctgttttggaaggagtgcgagatacactcgctgcaaggaatgggagcctgcatatggagcgagagctcaggcagaattactagcatcgcagccttaagtatgagaggttgccctaaccggagccttgcactagctagggagaagactccatctgtattggtttctggaacaaagcccagacaaggcagagtcagtgccatttctttgcattcactaaatattaaatgttcatatgtccttaacaaaattgtagcccccaagaaccatggaatttcagtcaaagaaacatgcatacatgcacatgtagataatctttctgctttgtactattcgacccgtgttgaaatcccagggataacattgcctttcagataaagtttgaccatcatattacccacacacaaaaaagcatcacatgaaataaagaaacaggagcatgtggtacaccctccaggactggagaagaaggtggcttggtctgggttagagactgatagctaaaaactaagtctggctgctgaaaactagccatatctactcaataatgcacatgtccccatggaaactccttatcttgccttccactccgttaagttttcatattcatggctccctgtgaaacctagagaagtatatttcttgaaagtcttggttagtagcctgttcacttccttgctattctcatggcaaagtaccaacgacgtgtgtcggcaaagagcgagatagtgagtttacattttagagtgtaatttccttatgaagccatccgttttgtttgtaacagtctgaccgttctaaccagcttctaggagccaggcgccaggacagaggaaaagaacttcattttattaaaatggtggcaaattcgattagcgatttcagtggcacattaagcaggttattattagacagaactgacatttcacatgcaggcatattctttacttgaaagtcaagtgtcattcaaaagagggagaaattatttaggatttttgaaaacctcaaagaaatcccctgaaaacctctccttataaatgcctccacctgttgaggagtcagggctagaactgatgactttgatttctccttgatgcaaacaatgataccagaatggaatggctctggggagtgctcataagcagtggtcaggaaagtggattctccttctacatccgtagctggaccccagtgctgacgggcctcgccgaagggcggtgtgattcattcacagggcacaccacagagaactgccccttcctccatccaaacagaatcatcctcctgctgtatatacagatattgcagcagtcactgagatacttgaagagtttttcactgcgtctgcctttggaggtacacatttggctcggcagaagctaaacatttttaagagcacagtaagaaataggccagaaaacatgaaagctttatagctttttagaaaacttgatggtcttgctggtacagctccctatgatatggttcagttgtaatagcaatggaaagtgtatcagtgcaagctgctgatgaaacatcagaaaatgtagccaagggtcttttaaacacattcaagaactgttcttttgaactgtgcctcttagccttggaaaacctcttcaagattttaaacagggcccctggatgaactatagagtgagaacctgaaattatcttgtgcactggaatcaatatcaagcaatattttctctttgagagaaattcaatctgacagaagggagtaggagcaataaggaaactgggaccctggctgaaatgcttgcctgagaaacacgcggcaaagcagtacaaattaggtgatgtcactaaagtcagaaaaccatagtgacagaataaaatgttatctgagcttcagaatacttcattatcactaccacaggtcactaagcttcacaaaatgcatccatcagccttgatagccatttggaggccgccgctggtagctagatggcgcagcagcggaacacagcccctccacctcaggagaccagggtgcagcagaggcctgggcgcacagagcaaagtttgttagtctcaaagtgctctctagtggccatatgaacataaaattatctgaagcagggagtcacttggggagaggatttagaattaaagggctgttgccgagcctgtaatcccagctattccagaggccgaagagagaggattgcttgagcccaggagttcgagaccagcctgggcaacacagcgagaccctacctctaaaaagttcaattttttttttaaagattaattttggaaagcaaggtagagtcgctttccactgcaatctacatctcctggatctgggggaacagtttatgagcaacttgcctttcccaactattgtgctgctacccataaaacacttataaattattaaactcagctgtgtgatttctagactggatattagaggtttctcaaattcatggggaagcatttaggtttaaattcatccttgcagatttctaggagtttcattcatgaagggtatttctgagtagacggtgaggtacatttatcctgtccatctgtgtgacatgcagaagctctgtgctgtgatccaaagccaccttggctgtaaatgtaactgtttagggaatgtgataagagccagctgctaagcttggtgggaggaaatcatttctgaagcacccacatattccaggtacagtctcttattttatcactagtattcattcaatcctcacaaaaaccttctggtgtaggaatcattatctctcttttttttcttttggcccccagataaggcaggggtttacaaactttacatgtaaaggaccagagagtaacgattttaggcttcgagggtcacacggtctctgcgtctctgcagtgtgtgtgcatctactcaattctgctgttgtaaagagctgtcaaggacatcaacaaatgagagtggctatagccaaccaaactttatttatggactctgaaatgtgaatttcgtctaattttcacatgcctcaaaatattgttcttttcttggtttcatttcaaccatttaacaatgtaaaaaccatccttccctcaagggccatgcaaacatgggcagggaggccgtgcaaacacagtggcctgtgccagccaaggcaacagttagttgtcaagtttgccgagtcctgtgatgaggaaccagaatcccagtttgcaagtcagtacgtggtggcctcagtagtccaaacagctgactgtggcccaggttgaactgggagtcatcggtggacatcagccctcctcctgctatccaccctatggtaatgcttttttttttttttttttagaaaaagaaaatttaatgtgtacttctctaggaagagccaagcaaagacaaagaaagacagaaaacagcactgtgggaaaccaatctggcactaaggaatatgtacagtggtgccaggaagactactatttaggactttataaagacttctgaatcagatggaaggcacaggtcccaaattcacagggcttcctatcatttaggaaatccattagaaattcatggaaacacaaatttaaaagcttgcaggcatatatccaatcacattcagcaatagggaaatacatataataagaattgcttctaggaccgggtctccaatccccagctaattttttgtatttttttaagtacagacagggtttcacatgttgcccaggctagtcttgaactcctaggctcccgcgatccacacaccttggcctcccaaagtgctgggaccacaggcatgagccaccacacccgccttatttctctagaatttagaacaatttctacaatgagctcttaggctatttagcaaaagaaacacagacttgttcaggaggatggagccctcactaatggggttcattgccgagatcgtgccactgcattccagcctgggtgacagagcaaggctccgtctacaaaaaaaaaagaacttttctttttcattgagagaatgggaaaggtaagttatagcaaagaaagagcatattatggaaatgataaaagacatcttcagtatatataaagaattcctacaaatcaataagaaacagtcctacagaaaagtttgcaagatacttgacaaacttgactttacaaaagagggcacaaaatggctgataaacgtgtttgaaatgtgctcagagtcattggtcatcaggaaaagaaaattaaaactacaatgatatatcactatccttatcagattggctagaatgcctagaatttaagactgaagacatcaagagctgatgtgaatgagtaggagctgacaagtctactacactcctagtgggagtacacattggcagaatctctttggacaactggcctgatctagtgaagtttaatatatgcatcctctgcgacccatcctccatttctagacataggcccacagaaacgtgcacacatgcgcaccaagaaacgtctttctattattgttcatcatagtcaagaaactgagacaacccaaatgttcatcaacaataaagtgataaattatggtgtattaatacaacagaatactatttagcaataaaaataagtgaacttctggtacatgtcacatggatgaatctcacaaagatcatactgagctagggacactgtgccaggtatttaactgttgtcttcctgcttcaagcccatccttttattctctgcttggcaatgctgagactaggactctgcaaagcacatttctgcttttctagctgtctctctgctaggttctaccaatagggggcaccagagggaggcctcaaggctgtgaggaagacgtgactggctccttcctggagcatgggttgttttccgtttttcctccatcacacacacaaagaaagcatcattgcatccccttggaggtctgggctctgactccgcagcatccctcctcttgctgttctcaattttaatagttccagcttctttcctttgtctccccagtcctagaggtggtaattgcaccctgacattgctacctacatacctcagtgtctctttctctctgttctgtaatacccagttaggaattcattatattaaattatctctgttaaaataactggtgtggcttctagaacctgttgccaccaaatacaaaataatagcgtatgactcaatttattaaaaatttaaaaaatgggtaaaacaaggggcacttctagagagaatggagggaatctccatcgggaagtgagtgaggtggtggcggtgggtgtgctgtgttctgtttgttgacgtgggtgatgattacccacgtgtattttcttgtgacaattcattgcactatttgtttatgctgtgcatttgcccttgtgtggtttttacttaaattaataataatttcttaaattcctcaaacttccgccgggcacagtggctcatgtctctaatcccagcactttgggaggctgaagtgggcggatcaccggaggtcaggagtttgagaccagcctggccaacatggtgaaaccctgtctctactaaaaatacaaaaattagccaggctaggtggtgcgtgcctgtagtcccagctactcgggaggctgaggcacgagaatcacttgaacccgtgaagcagaggttgcagtgagccgagatcacccactgcacttcagcctgggcaacagagcaagactccgtctcaaaaaaaaaaacaaaaaaccaaaaacttctttatatgtaagaagagatgttcctgacatgaaaaaatagcaccctttacagcactttttctcctagtgtggacaactggcgggattacccaaggttgtcatttaaaatacagatgacaagtttccatcttcagaggtttcaagtcagtaggtctgggatgaggcctgggaatctgaagctttctcaatctctccaggagctttttacataagccaaagcttgaggctcactgatagtgactgaactgagcttctttctttcagagctgattcatccattatccacagtaactcctgcctaccctgatgacaccaagcacggcctccgcattcctgcagactaggaatttctcatgtatttattctaataaagttccagtgtagagaatcatctcatggagttgaaatactggaatttcactcatcatcggcatctcttcctggagcaaaggctagaagaagcctcaagagctttaggtgtaagattgacctaggtgatagctcttagcatttgagggaccttttgagaatctgctggtagctctggagtgtccctggaactatgcacacacatgcagttggcacatgattttggagggtcacatgtcacccatccataaacaacatcctaggaatttagaaactcacagttagggacctctgctgtggggactcaaagcccattcttggtgtaactgttttcggcagaagccagtaagaactggaggtttctgggaaagcatggtgtgctccaactactgtacctgctgatctctgtcggttcccttagaaagaggagaagctgcaaagggaagtcacaagagtcacattctagttctactcctaacaacgatgggaacttgtttctgcttcttcatatctgcgccattttctcctcttaggaaatggcattaatgcttttcctgctttctttctctttcttttttctttttttttttagacgcagtcttgctcagtcgcccaggctggagtacagtgacacaatcttggctcactgcaacctccgcctcccgagttcaagcgattctcctgcctcagcctctcgagtagctgggattacaggtgtgtgccaccaaacccagctaatttgtatagttttagtagagacagtttttcgccatgttggccaggctggtcttgaactcccgaccttaggtgatccacctgcctctgcctcccaaagtgctgagattacaggtctgaaccaccacgcccagccttgcactgctttcttcacagggctgtagagaggctcagagaagaggtgaaaggcctgtacactgagaagcatatgcatgtttattgggcacccactgcatagcctggttcaggccttgcatggattacggggccaaacatttgtgaaatatttatatacaagacaaatacagctgccaggtgttgtccatagtccacgttcaaagggagtaaagtctgcctcaagttgtagccaaagaagaaataggtaaaattaagaaatatggagctgaaattttttaaaaagggcaaaaagaaagaaactcacaaattaaaaaaaaaaaacaaaactagatctgagagttaacaaaatgtactaactgcagtaactgttgccctgagggcatttccgctctccaaaggattcttctatgaaggagagttgggcagtcacccacctgtgaggctggtcctggggccctggacctctgaggctccatccctgtgaccaacagctgctctcctcacagttacactctgctcctgttttcctctcctcccacgtggaaacatactcttattggagtcaaggtaattgatctcaatttagctattacagggtcatcttgtaatctatcataacaaatgatgttttcattactctagattattatacaccatggtctacaggatgtgaaaaatctaatccaattcctcacttcatgtagacacagcagaaatcctttccactgatgtttccgtcaaaagatctgtcaaaggaagggcgagaaagaagcacagcctccccgcctccccatttagcaggcagcagttttaaatatctttgttgtattgctcttggccagattctaccgtccgatatttttgatactcccaggtctttaattttaatataaaaattttgcttgaaaaaatagtgatttttcttttatgtgggaaagtattatattaatataaccaatgttcattgtttgatgcacagagcaggagataaagtgaacagatagatctcacacagcttcaaaagaatttttgtttttgtttttgttttaagacggagcctcgctctgttgcccaggctagaatgcagtggcgtgatcttggctcactgcaacctctgcctcccaggttcaagcgattctcctgcctcagcttcctgaatagctgggactacaggcgcccaccacagggcctggctaatttttatattttagtagagacggggtttcgccatgttggccaggctggtctcgaacttctgacctcaggtgatccacctacctcggcctcccaaagtgcagcttcagaagaatttggattccatttttgaattcagacccgtatcatcagctgagataataactaaaaatgtaccaggaattttctctgacaataacagacattgtattgaattcattagtgcttgagtcaccaaatagaaggttatatctggggaaaagaatgagtttagggttcacaagaaagccagttgacatatgctcggtcatattactagtatgaaagcttggagccaaagagaatattcacagatttgtgtgtacttttattcatcatcagcggacatcagtgacataatcaggctcaccaaagccccctatttctagcagagaggaaacattctaggtgtgactgtaaaattataaggctggctgctgtggagtctgtctcattactttataatcacattccatggcctcctgaagtggtttgccttgttcttgattcaacagttttactaaaaaaagaaatattagttgttattacgcaagtttattttacttgcacctttcagaatcttgaagtaaattttgtctattggccaaccagagcccctctttttctggtaaactttacacttttagttacccacactttctagaaattatgaaacccagtaatgcaaactggcatatgtcagaaacactataaatattcacaaacgtcatcatcataatcaacatcactaagatttactgagcacttcacatgtgttacatcaggtaattattacaaaaactcagtagggatataattatccccatttcacagatcagaaaattgaaattatagaagttgagtaactcagcaaagtcacagggataagtggcggagccaggagtcaaacccaggcattttgactctggaggctgcctcgacttctgtattatgctgtcatcaaaaagggatagacacagtgtacatcagtacaatggatactcagtaaataggaagaatcctggactttaagaattattaataatatgggaaatgttcatttaaaaaagataaagagaaaaatgtgttgagaacttactgtgtaccagatgctgtggtaagttgctatatatacattgtctcatttcatcctcatattaaccaatgacgcaacgaattatcttattatctctattttataaacaaccgagtcagagatttaagaagcttggctaagttcacacgactaataaatcacagagccaggatttgaacttatgtcgatttgactccagagcctatggactcaatctctaacctatactgcatcttagcttacccaattacacacatggttaatttgggcaatgtgtgcagatatgtaggggcaagactggaaggaaaaacacaaaacatttaaaagttgtcgtcaccaagagtcagattatggatggtttttattgtcttctccatacttacctgtatttcccaatttttctttgacaggcacttatttctttttcggtcaatgaaaacattattaataatacagaacaaacatattacctgtgtgccatgcactatggcccccggaatccctgctccagaagtaacagcaagccctgccctctagcttcagcctcttcctgcaggctggatccatttcctaaccttcactgaaaccaggctgtcccaaagcttatctgtggaggtgactattgccactccagaccatcacctcccacctctctcccttgagactcacagcatctgtcagtaccaacatatccccaaccggacccgacctctgtccctcaggtatccttcatcaccttttttgacatcttcagtagctacttagatgacccacccaacaccctgccaatcagttcctgggcttcctagggccaatgaatacattttcctctgctccatgactgccataggctgcgtgattcacatgcctcgcccaaacttgcatcacctccagaacactacatataccagccatgacctcttatcttctatgtcacttgatcaagtatttctaccatatttcgcctttaattatgacataaaattctcggtttcttgatctccatcagtcctttccttccttcacattttttctccagattacaccccatggcccgtcattataaccaccttgccccctctccctgcatcatgcttgcctaaggagacccaggtgctcactcctcctcagctgcacccagcaggtgaactttggccagattcatacaactaagcaaattggcttcactttaaaattcatcctcctgcaccccaaatgggctttcactgtaacccagcaacccagtgcatttttgctagtaagattactgtccctgtctccaagaagaccatttcttctctcttctcaaactctctacccttcctagtggcctcctcacatcctccatccactttaacttacacttggctgagaaaataggggccatcagatccgccctcaccttcccaccatcagattcacaaactcatccacacttgacattgttgattttttttctttcctttagcaactgagaaaacaacttccttttctatcaaaggccagtctctccatgtgttctctgcatcccatcccttctcaagatatttgcttctaagttatccctttctaaaaatcagtaatgtcaagtttccctcagttcatttcccatggcttcataacacagaagcttccatctttcaacatttcagcatattctaggcaaggttaagagttaggataaatgatggaacaatacttctttcttttttttttattatactttaagttttagggtacatgtgcacaatgtgcaggttagttacatatgtatacatgtgccgtgctggtgtgctgcacccattaactcgtcatttagcattaggtatatctcccaatgctatccctcccctctccccccaccccacaacagtccccagagtgtgatgttccccttcctgtgtccatgtgttctcattgttcaaatcccacctatgagtgagaacatgcggtgtttggttttttgtccttgcgatagtttactgagaatgatgatttccaatttcatgcatgtccctacaaaggacatgaactcatcattttttatggctgcatagtattccatggtgtatatgtgccacattgtcttaatccagtctatcattgttggacatttggaccggctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcacaggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaagtttcgcaacctacccatctgacaaagggctaatatccagaatctacaatgaactcaaacaaatttacaagaaaaaaacaaacaaccccatcaaaaagtgggcaaaggacatgaacagacacttctcaaaagaagacatttatgcagccagaaacacatgaaaaaatgctcaccatcactggccatcagagaaatgcaaatcaaaaccacaatgagataccatctcacaccacttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggaacaatatttctttggaatcaactagtgtcagagttacttccttaggcccataccagactcacccacatctgttacagcctgaccatacaaaaggatcccttttgctctgggagtaccttgcatcttggtcctccaagaaaacagaagtggcacacgcatccacctcttctagaaaccaggtgccctggttggataggatgttttcttgttgaggtaggctgcacttgcatgggaaaaaaaaatggcatggtgacctcttatgctcattctaaaccagttggaatagttccaggggaatccagcctcacaaaactgaccttattaggtgccaattggtatgtattggtcatgagatagatgagaggcagggcaggattgttgtccaggtagcgatgggaaattgagtagggtccattctgcttggctttagccatccacactcttaatatgccagcctaaagattattgtcttgcaaccttctgtttattattgaacaataaactaaacatactatgtgacaataacttccctggggaaggtttattccagtgaatgatgtagctcttggctccatacttcctcaggagttccagatgattccattccctgaatttctgcccatcactctgctctcccacttaccataacagatggtggagaagttcctgtacccagaaagctgttactgcagcttcctctcacatattgccagtctggctgcccatggacagactgatatcaagaaggagacaaaggagaggttgcaggaaagtaagagtgatcaagagtcaaatatggccaggtgcagtggctcacgcctgtaatcccagcactttgggaggctgaggcgggtggatgacctgaggtcaggagttcgagaccagcctggccaacatggagaaaccccatctctactaaaaatacaaaaaattagcagggtgtggtggtgcatgcctgtaatcccagctctcaggaggctgaggcaggagaatcgcttgaacccgggaggcggaggttgcggtgaaccgagatcgagccattgcactccagcctgggcaacaagagcaaaactccatctcaaaaaaaaagagtcaaatatggcagaggctgtcatagagcaagagagcgttccatcttctagacgctccactcagaggaaccgagaaacttgagcttgcacttctagagcactgcaggtctccccaggaaccctcaggaataaccaccttctccccagccttgaccatgaaggaaagttcagtgggatgaaccccaacaggaaggcagggggcagaaaaaagagagagaaagtctgggagaagttcttccagacacacagctcagctgactctgagtgagattattaaaaccaatgagaaagaatggaaatcactggcaccaccctttgggccagctgtcttgaaagcgtgctccatagaccagtgtctgtctttgcactgcatgttgagtgtgtgtgaaaagtacagacattgaaagtaaccgtttagaaacaattaaagcaatcggacagagtaattctctgtctattgaatctaataataaaaacctgggacctgtattttgtatgtcttcattttttttctagaaatcccttgatcttatttgacaaaaaatatagattcggtacagatcgtggggaaatcccaggtcctccctcccagactatttgagaagcactgtttaagactaatgtttgtagtgaagtcacagtgagagcatgttctttctgatgcaaacacacccacctcctgccctcgtgtcctgcaggctgacctgagagccagctgcatagctcaagccacaaaggaacctagtttttggaaagggtgagtatgaaaataatacaaggtaaagaaaagaatgttacttaagatctacttattatctaaatcctgcccccttttcttaaagactggaaagacaaagaaaaattggatatgtttagaagtaaattacctcccaggcagcaagagagatttagaggctggaggtaaagtatctctttcttaaagttcaaagagtgtgacaaaaaggtagatatagagacagatgagaaaaagagaacagagaatgaaagagctcaaagcagccctgtattagtttgctggggttaccataacaaaatactacagaccagtggcttcaacaacagacgtattttctcacagttctggaggctggaagtccaagatcaaggtgtcggcagggttggtttctcctggggtctctctgcctgccttgcagacagacagctgcctgccttgcagacagacagctgccttccctccctgtcctgaccaggtctctgttgtttgtcttaatttcttcttttaaggaaacctgtcatattagattaagtcctaaccataagaccttcttctaccttaattacctctttagaggccctatccccaaatacagttccattagaggttagggcttcaacatgtgaattttggcggaaggggacacaactcggtccttgacaggactcagacttcaaggacactcagggttgtgctcagcgtggactccagggggcagcagagatttgcagccggcctgggcagagggcaaggccacactccaggcccgctgtcgcgtgccctcgccctcaacgttccctctcggattttcaggaatttcatttcacgtccttgttccctcctatgtaactgacaacgcagaatccgcaggatgtgaggagtggaccccttattaactccagttcccaaaatcacaaaaatatggaaccaaaatgagctgcaattgacaaagcaggatattatacagagaaaactcctgaaagcatggctagagataaagtagctgaggtctatataacttgctcgtaaattaaggtgtttttaacattttaaaattaatttagttaattaattaatttattattattatttttgtgtgtgcgtgagacggtgtcttgctctggtgcccaggctggagtgcagtggcaccatctcggctcactgcaacctctgcctcccgggttcaagattctcccacctcagcctccagagtagctgggattacaggtgcctgctaccacacccagctaattttttgtatttttagtagagacagggtttcattgtgtgtgtgtgtgcgtgtgtttctttttttttcttttttcttttttttttttctttttttaggagtcttgttctgtctcccaggctggagcagagtggcacaatctcagctcactgcaagctccgcctcccaggttcaagtgattcttcggctttagccttccgagtagctgggattacaggtgtgcaccaccacgctgggctaatttttgtatttttagtagagacagggtttcaccatgttggccaggctggtctcgaactcctgaccttgtgatcctcccacctcagcctcccaaagtgctgggattacaggaatgagccactgcgcctggctcagtgtttcgtttttaattgacagataatatgtacatttatgggggacactgtgattttttgatgcatgtatacaatgtgaaatgattaaaccaagctaattaacgtatccatcacctgacttattattattattattattattattattattattttggtggtgagacactagaaatttactctcttagcaatttggtttctcaaaaaacaaaaaatagaatgaccacgtgatccagcaatttcatatatgggtacatatccacagcaattgaaatcgacatgcccagagatatctgcactcccgtatttactgccgcagtatccacaatagccaggatttggaagccacctaagtgtccatcaacaggtgaatggataggaaaatgtacactagtgcatatacacaatggagtactattcagccacaaatgaagcttacaaggtcactgtagcagatgctgccaacggcctggccatggtcctgagccctgatgttgtgaagcacacaagcccaaagctccgagggctttccttggtcaagagccagctctgtctgctggcaggggagggtagaagttccgctccagtggcccacagccagagccagggggtcctcgttccagtctacactgacccagcggtcccagcaggactgagctgcagcaccctgtgacagtcagctcgacgccccagcccgcactggccgtgctgcttccctatgtccctttcccacctcctaccagtgtttctaggtcagcttccacatcatgacttgagcttgaatcttcagctcagttgtgttcccaccctcatagattacctattaataatcggtttaatctggcagacaccaccttaactatgtgaacaaatttagcatcaccaataatgggacaaattgaggtaatgggaagtacacagcatcacctgcaaaatattcttcatgaaaatcatcaagttcaatcaaccatgtggggccaggcgcggtggctcacgcctgtactcccagcactttgggaagccgaggtgggtggatcacctaaggtcaggagttcgagaccagcctggccaacatggtgaaccccatctcttctaaaaatacaaaaattagccgggcgtggtggcgggcacctgtaattccagctactttggaggctgagacacgagaatcgcttgaacctgggaggcagaggttgcagtgagctgagatcatgccactgcactccagcctgggtgacagggcaagacgccgtctcaaaaaacaaacaaacaaacaaacaaacaaaaaaactacgaggaaacacactgttcttcagtcaattgtgtctggtgtctgcccaaaatctctccatgtcgaagtcctaacatgcagcatctcagaatgtggccctatgcggaaatagggtctttgcagacgtagttgagatcaggtcacactagtgtagggtgggccctaaatacaatgaatggtgttctttgtaagaaagtggtgtgaagaccgaggcagagaagagttatgctgcccatagtcaaggagtgccaggagccagtgggggctggaggaggcatggaaatgattatctcttgcagcatttggagggcgcgtggccctgccaacaccttgattttggacttagagtcaccagagctgtgagacaataccttactgttgttttaaaccaggcagtctgtgctacgttgtcacagcagcctagggaactaataacacacaaattcagattgtgggatgttctgcaagacaactggtctgattctttaaaatatcaatgtcataaacagcaaaaacacacaaaaaatgggtaggagattgttctagatgcaaaaagactaaaaagatatgataactaaatgcacaatgtggttgttggttagatcctggatattaagggaataattgggaaaaactgaatatgagcagatcagttttaaatttattaggtttgctaatggtactgtggttatggagatgttcttgttcttaggattacagagtacttaggagagacatatcctgatagctacaatttattttcaaatggttcagagaaaacagtacatacacacatgtaaccacataaacattgaataagcaaatatggccaaatattactaattagtgattctagatgaaaggtatatgtattactctttcaacttttctgtacttttggaatttttcaaaataataagttttgagaatattacatttcatgtgggtgttggtttatgacaaacaataccttttcacagatatgaagcctatatttattttctaacagaaaacaaatcggttgatttttgttccattcacatcttgtttgcttctgtagatataagagatatacgactgtctcctctttagaaaccagaagggaactgaatagaccgtcctcctaaaatttaaatctctttgggtaggatatttaaatctctttgggcactctagactctagatatgtcatcgggcagacatcccctaaaaccaacaggtgcacacacacacacacacacacacacacacacacacacacaggaccaggcacacacatgcatgcatgccacaccaaacaagtacatttctgaatttcaactaacttgtcttttagtcctaaaagaccagtaccccacagtgagattcagcgttctttttgagagtattataaaatgctgtgtgacggttaatgttaggtgtcaacttgactggattaagggatgcccagagagccagtaaagcatgatttctgggtgtgtctgtgacagtgtttccggaggagactagcatgtaagtctgagtggaccaggtggggaagacccaccctcagtgtgagcaggcaccatccaacccgctgggggtccatagagaataacaacagagaaaagacacatgctgatccatctgctggagctgggatactcttcccctatctttgaacaactccaggctctccagtctttggactccaggacttataccagcaacctcccctaccaactccctgttctcagaccttcaacttcagactgagagttacaccatcagcttcctggttcagagccgggctactgacatcccagggtctccagcttgtagacagcctgtcgtgggacttctcagcctccgtaatcacatgagccaattcctctaataaatgccctcttgtctgtctatctatctatatatcctattggttctgtctctctggagaactctgaatacatgaccttctttcatggaataaaccttttaaaatgtatttttctcattcaattatttaggttcaatgtttatgtggcagtgctgagaactctgaatatgtttccatcatattcaaagtattgctactctctggatacctcagggtaatttctgacattatgacaaatataaaaacctgaacggctgaacttgtgagtacaaagtagttttattatggcattataaagtatctctcaaaaggacccactcagtcatatactagaatttatttctatagaataaaatttcatttttatactggagaattgcaggaatagtttctttatgtgtttccaggctttgcttcaagcacaactggaaagaatacctctggcattaccataagaatacaagaggagagatgtaccttgataaggccataattgttagctgtaatatctatacaatatggctatattttatgtaatgtattaaacacttatttttgaatttaataggtaacaggaatagaatgtaaatgaaatttaaattggtcaaaaaatgacaacaggaatgactaaggtacaaacttcctcagccttcttattcactgttgattctatttccttcttgaagctctccctccgctggcttccatgatgcacctgctccctagttttcttctggcctctgtggctgcttcacttcattatccttgatggttcctcttcctccagtcatggctgaaatatttttcctggcccgatcctctctctaaacagtctctctgggatcctatcacagcttcagctgccagtgatgacttcagcatgtccaccttgagccaagagaacttcaaaatcaagtacgtattttcccactggacatctcttctcatgccccatagggacctcaagcacaacatgcccaacactcacactgtcctccttctgcattcccttgtccctccttctgcattcccttgtccctccttctgtattcccaaatgtccctccttctgtattcccaaatgtccctccttctgtattcccaaatgtccctcctgtattcccaaatgtccctccttctgtattcccaaatgttcctccttctgtattcccaaatgtccctccttctgtattcccaaatgtctctccttctgtattcccttgtccctccttctgtattcccaaatgtctctccttctgtattcccaaatgtccctccttctgtattcccttgtccctccttctgtattcccaaatgtccctccttctgtattcccaaatgtccctccttctgtattaccaaatgtccctccttctgtattcccttgtccctccttctgtattcccttgtccctccttctgtattcccaaatgtccctccttctgtattcccaaatgtccctccttctgcattcccaaatgttcctccttctgtattcccttgtccctccttctgtattcccaaatgtccctccttctgtattcccaaatgtccctccttctgtattcccttgtccctccttctgtattcccaaatgtccctccttctgtattcccaaatgtccctccttctgcattcccaaatgttcctccttctgtattcccttgtccctccttctgtattcccaaatgtctctccttctgtattaccaaatgtccctccttctgtattcccttgtccctccttctgtattcccttgtccctccttctgtattcccaaatgtccctccttctgtattcccaaatgtccctccttctgcattcccaaatgttcctccttctgtattcccttgtccctccttctgtattcccaaatgtccctccttctgtattcccaaatgtccctcctgtattcccacatgtccctccttctgtattcccacatgtccctccttctgtgttcccaaatgttcccccttctgtattcccttgatcagcaggtgatatccttttcccaaccaaaactttgggattacctgagacttctctctatcccttgccctaaagttaattgctcaagccttattgattctataacctgtttgtttttttttaaaaaaagagacaggatcttgctctattgcctaggctggggcacagtgtcacattcatggctcactgctgcctcaaactcctgggctcaagcaaaaattctccagcctcagcctcctgagtagttgggatgatagttgtgaggcaccttgcccagctaatattaaaaaattgtttttgtagatgtggggtctcactatgttgcccaggctggtcttgaattcctgtcctcaagtgatcctcctgcctcagcctcccaaagtgctgagattacaggcatgaggcactgcacgcagccttttaattttttttccttttcccatcttcactttcaatgacttggttgatgagtcaacatttctagtaatattccaaaattatttccgtcttttggaggttgtgaatctactccttaaattattttcagaatgattttttaaatatgcaaatactgtcatgtcactactgagaatcctccaatccctcccctttaatgaatggcatttaacctccaattcttgctctactgcctcacagctgtctggctttgtacacactgcgttctttctctggaatgcccttcttccactggcttgtctagccggtgcctactgtccttgaaagagtcagctcaaccatcatctcatctgggaagactgttctgttagtattaggatacactgattaggtatccctctgtgtgctgacatactattctgcttatacatctgtcagatgtatataatataatgatattgatattcattaattaatataacataatgatattaacttatcttcttgcctgtgtccttcactggattgtgaatttcttaagtgtagaaactgcctttatctctgtattcatgtagcatggcatataatatgcgctaaaaaaaaaagtgctaaatggaaatagatactaaaagtgtatattgaagactttcagtgaaatgggtcattcaagtatgatcattaatatcaggttgagcgtggttgttcacgtctgtaatcccagcactttgggaggctgaggcgggcagattagttgaggtcaggagttcgaaaccagcctggccaatgtggtgaaaccccctctcgactaaaaatatttttaaaaaattagccgggcctggtggtggtcacctgtaatcccagctactcgggaggctgaggcaagagaatcgcttgaatccaggaggtggaggttgcagtgagccgagatcgtgccattgcactccagcctgggcaacaagagcgaaactccatctcaaagaacaaaaaacaaaaacaaaaacaaaaaaacacaacaacaacaaaaaaactataatcattaatatcaaagtttagcattggtggtgagacccataatcaaacattcatttttctcagcaccaattttaacaaagattaattgccatagaagaaaaaaaaagaagttttaaaatggtctgcagagatggcttccaggttgtaggtagataagagacaaatggttgccttcttttgagtctttgatcacccttttactgtatgtacaatttacatgtgagacaggagtagaggaatagttacttatgccttagtctggctcggtgaatctgcgtttttacgtaaacaataggggagaggaagcaatcagctatgcatttgtctcaggtgagcggagggactttgagttctgtcctttgtcccacacctgtgaaaataagctatcaatttacattgtcagggtgaaattcaacagaattgttttagggtaaaagatcttgaggcccacaagaaatttccctgtggacaaattgtgaaggaggtatgtagctttttcatctttgtagctatcttatttaggaatgaaatgggaggcaggtttgcctgatacagttcccagcctgacttttccctttggctcgagatttgggggtcccaaggcttactttcctttcacaatatgtaaaatagcctgatttagccattacacaatgtatacgtatatcaaaacatcccattgaacactacaaatacatacaattttttcttgccagttaaaaaatgaaaaagtgagaagttaaaaagtaacaaaaagtgtttttaattgtctacacaaagttgctatactagttgtaagttctctcatggcattatgttagaaccaccaatgacagacattattctgtttttcctttttttattctgtttttctaagttctcaatgtatttttacttagactgaaaacctatttttcaactctgcaggtatcacttaggctttctaatttgcattcagttgaactgcagctagctggagacttaaaaaggaaatactcttttatcatttatataacaagtgctgcaggttctataatctttgagattcatatgaaccactgatttgtgacaacatcagctgacattttatagaccatcagagtcatcctcaaggcagaaatttacagtcttgtgtctaatagccaacagtcacagaagtattcatgcacctgctaacatttatagtcctgaacatcactgtacaacttcattgtactgtacaatctttgacagcaattccttcttctgttttcaatcattcttggttatgaagctataaagttatgaaaacatgagaattagagtcttcttttaacactttttggtctgtgttttttcaacagcaaaattggattattcagctcatgtgaagacttatttaaacccttcatttcttttcattatcagtctgcttctctccatgggaaagatactttattccttcagcatgtagggtagacaatcttgactcctttggtattccatcttggaaaatagaatcctacagagattaccatctatacatttcctttttttttcccgagtgaggggaaaaagttaggcgtctccaatgtccaaaggccaggagacacaatgatgaggtaatgtgcggtgattgttcagcaccatgacgctaacccatatcagtgattttttaaaaagtgttctggctgggcgctgtggctcatgcctgtgatcccagcgctttgggaggccgaggcgggcagatcacgaggtcaggagattgagaccatcctggccaacattgtgaaaccccgtctctactaaaaatacaaaaattagctgggcgtggtggtgtgcgcctgtagtcccagctacttgggaggctgaggcgggagaattgcttgaacctgggtggcagaggttgcagtgagctgagatcacgccactgcactccagcctggcgacagagagagactccgtctaaaaaaaaaaaaaagcattctgcagccataaaaagaatgagttcatgtcctttgcagggacgtggatgaggctggaagccataattctcagaaaactaacacaggaacagaaaaccaaacactgcatgttctcacttataagtgggagctgaacaatgagaacacgtggacacagggaggggaacatcacacaccagagccttcggcgggtgggcagcatggggagggagagcattgggacaaatacgtaatgcatgcggggcttaaaacctaaatgacgggttgacaggtgcagcaaatcaccatggcacatgtatacctatgtaacaaacctgcacattctgcacatgtatcccagaatttaaagtaaaatttaatacataaataactttttaaaaaaattctgcctatacaccattacccaaaacgaatcacactaagtgatcttttgggatgaagaaaaaaaattataactctcacttataattagttttatttttaaagttaagcttaactaatattaaatatatggatagacaggagtatatatgtataatttatttttttaaaacatatagattagggcacatgctcaaaatatttttattgatatatacacaatcaagtaagttttgagattgctactagagatcattgcacatcactgaaaattttggccagggtaatgacattgcaaaaggggaattttagaaaaaacaatctaagagcaatagagaggttaacttggaaagagcagatattcaaattagacatgccaggtaagaggcttttttttttttaaccatttgtctaacactttattcttttacatttgatgtttctttgtcctttttaaaaaatttttttttattatactttaagttctagggtacatgtgcataacgtgcaggtttgttacatatgtatacatgtgccatgttagtgtgctgcacccattaactcgtcatttacattaggtatatctcctaatgctatccctcccccctccccccaccccacgacagctcccggtgtgtgatgttccccttcctgtgtccaagtgttctcattgttcaattcccagccaggtaggaggcttttgcaagaatctaaatatcaactagggtgatgacagtgggaaatagaaagccatagttataagagatgatgtaaaagaataacttaaaatattaaaaatgaaaaaaaaaaagaatgtgtggaaattttgagctaagttggttggggaaaaaaacaggaatatccattaggggactcaaattgcactatgattgccactgacatacatgcccacatatataatgtagaagctacagtattatctgtttgaacatgaggcttgagatcctgaaaattcccataagtggaagacacacagttgaattacttaaaattttacaggaaaaaatggaattgtgaagcaaggattgcacccaaacttgtaaaagtccttagaaatcttgtttcttattagaaatcttatgtttcttatatataaatcgtatgtattttatgttgaaacaacaaataagaaagtccttctagttttgtatccactaaataagtaatgtgccgagcatggtggctcacacctgtaatcccagcactttgggaggccaaggtgggcagatcacctgaggtcaggagttcaagaccagcctggccaatatggtgaaaccccgtctctactaaaaaatacaaaaaattagccaagcgtggtggtgggtgcctgtaatcccagctactcgggaggcggaggcagggagaattgcttgaacccaggaggttgaggttgcagtgagccaagatcacgccactgtactccagccagggcgacagagcaagactctgtctcaaaaaatatatataaactaaaaataagtaatgaatattagataagaaatagcagtcagacttccagcttccattctggcacataaaaagtttggaagtgccatttcatcctaacaagtaaaaaactgaacaaggagaaacagataaatccactactacagtgggggacttcaacactcctctatcagaaatgaacagatacaataggcagaaatcagtaaagacataattgaactcaacatcatcaatcaatttgatataactgatgtctgtagaccattcaacaacagcagaatatacattcttctgaagctcatacagataattcaacaagatacactacattctgggccattgaacacaccttaacaaatttaaaagaatagaaatcatatgtctgctctcagatcacaatggaattaaattacaaatcaatagctgctgggtgcagtggctcatgcctgtaatcccagcactttgggaggctgaggtgggcagatcacttgaggtcaggagttcaagaccagcctggccaacatggcaaaaccctgtctctactaaaaatacaaaaattagccgggtatgatggtatacacctgtagtctcagctactcaggaggctgaggcaggagaatcacttgaactctagagggtggaggttgcagtgagccgaaatcacgccattgcactccagcctggcgacagagcaagactccatctcaaaaaaaaaaaaaaaagagaaagaaatcaatagcagaaacatagctgggggccagatggaatagctcattcgtgtaatccaagcactttgggaggctgaggtgggaggatcacttgagcccaggaattagagactaacctgggcaacatcgcgagaccctcatctctacaaaaaaaaaaaaaaaaaaaaaagttgggtgtggtggcaggctcctacagtcccagctgctatgcaggagcctgagttgggaggattgcttaagcctgggatgttgaggctacaaggagctgtgattttgtcactgtacttcagcatgggcgacagagtaagaccctgtctcaaaaagaaaaaaaaaaaaaaagaaacatagctggaaaaatttcaatactcagagaattagcaacacacttttaaataacacatggatcaaaaaagaaatctcaagagaaatttttaaatattttgaactaaatgaaaacgaaaacacaacttttcaaaatgtgtggaatatacccaaagtagcacctagaggaaaatgtatagcattgaatacatacaatgataaaaagaaacatctaaaatcagaatctaaactttgggcttagaaaacaagaaaaagaagagcaaattgaatccacagtaagcataataaagtgacaaaaattagagcagaaatcaatgaaattggaaacacaaaatcaatatagaaaatcaaaaccaaacttgttctttgaaaagattaataaaattgataagcttctaaacaggctaagcaaaaacaagagaggccataaattactaatactgaaaataaaaaagggggcatcactatagatccatggacactaaaacggtataaagaaatactatgaacaactctatgctcacaaagttgataacttagattaaatggaccatttccttgaaagatactgaaatgggagagttccctgacctccctcacaggacatgtgacagggttgtgtcttgtctgtttggccaccatgcgcactcaaaccccttatgggagggggagcacacagatggacaggtgcaggaactggggcaaacgcttttgggctctgaccccacagtagcatctaggggtgagtgtcttcaattctcacgcccagtgggcataatacagtgctcttttagctctgccattcgcagacagcttaagtgttaatcagctcagtgccctcttggtgcctgggttcttgtccagcatccaggaataatcaggtcacacatggacttgaaggaaggtgaatgtggggattttattgggtaatggaggtggctctcagcagggtggatgcggagctggaaagaggatggagcgggaagatgattttcccctggagtttggctgtcccacagtcgatctctctgaccatccccagctgacttcctttcaacgttcagacgttccttctcttctctcctctgctgtgccactcttctgctcctccgctcttctgtttgtctgctcatctgctagtggagcctgggtttgggatttatatggatacaagagaggggggcatggtgggccaaaaggcaaattttgggtacaaaaaaaggaatgcctgttcccatttagggccataggtttccaggcttgggggtagggccttggctggggaactgccctcttctacccagtatttatttccctgtctcctgtccatatcaacacaatatgccaaaactcacaaaagaagaaatagacatacgatatgaataagcctatgatatagtttggatatttctccccaaccagatctcgagttgaactgtaatcccgaatgctggaggtgaggcctggtgggaggtgtttggatcatggtggcagatccttcatggtgctgtcttcatgacagtgagctctcatgagatgtggtcatttaaaagtgtgtggcacctcccctgccacgctctccctctattgctcctgctttcaccatgtgatgtgcctgctcctcctttgccctctgtcatgatcgtaagcttctcgagggttccctagaggccaagcagatgccagcaccatgcttcctgtaaagccagtaaacctcttttctgtataaattacccagtctcaggtagttctctatagcagtgtgagaatgcactaatacaactaggcagagcacagaggattttgagggcagtatatgatactactgcccttacccacaggggcctaagtagagggctaatacacaatggcattcctaggagctgggtgcgtgtgcaaccaatagggtattgcttgacatatgcaatcaaaggcatcaagaatggatgatgaaggctgggcgtggtggctcacacctgtaatcccagcactttgggaggccaaggtgggtggattacctgacgtcaggagttcaagaccagcctgaccaacatggtgaaaccccgtttctagtaaaaatacaaaaaaattaactgagtatggtggcggccacctgtaatcccagcaattcgggaggctgagggaggagaattctttgaacccgggaggcagaggttatggtgagccaagatcgcgccactgcactccagcctgggtgacagagcgagactctgcctcaaaaaaaaaaaaaaaaaagaatggctgatgaaaaagtagaggtcagctgagcgaacaatgccagtgtcatcatgccccctcattagtaggaccatatgtagacaatgtgaaaaaatggggttctagcctaggcccacttacagtggggctccctcacactcatttggtggtcatcatcctggttccagaatccatgacctgggtgggcacactgagccactagcaatatccccacttgactctgtgacttgtgaagtaagaggagtagtatcctacttatagcaggcggtggccaatcagaaacaacagcacaacataacaggtggaatggcagagattaagacaatcttcggagactttaaaggatacaagggtggtggtcttcattacatccccattttttttttttgagacaaggtctagctctgttgcccaggctggagtgcagtggcacaatcttggctcactgcagctttgacctcccaggctcaagcgatcctcccacctttgcctcctgagtagctgggaccacaggtgcgcacccccatgcccagctaatttttgtattgttttttggtagaaacagggttttgctgtggtgcccaggctggtcttgaactcctgggctcaagtgatccacccaccttggcctcccaaagtgctggaattacaggaatgagccaccacgcctggcctatatccccattttattaccagtctagcccctgtaaaaaccagatggctcatgacagatgacagtagacttctacaaatataattaggtgatagccccaatggaagctgttaatccagaagtgtcttctctagaacagacgatcactgtctttgcaaatgtgttcttttctcacacccatcaggaagtaggatcagaagcagactgcagtcactttagatggacaacagtgaacatttatggccctgtctcagggctacgttacttctgaaaatacagtcagaagagttctgctgttacatagaacagcccactggtctactttattgatgtcattgtgttcatcagacctgataagctggaagtgataaatatcctagacaccctggtaggacacacgtgctccaggggacgagagagagactagaaagattcaggtgcctcacacaatgctgcagttattaggagtccagtcatctggggcgtgttgcaatatcccctccaaggtaaaaaacaagttatttcgccttatatcttggcccatgcagaaaaaagtgcaatatttagtaagcctctttggtttgggaagcagcatactccatgcttgggatcatctctatgaccaacttattggctggctcagtgctgctggttttggctggggtccagaacaagagagcgctctgaagcagattcagcctaggaggcaaacaggactgctgcttgggcctcatgtcctggaagatcccttggttctggaagtatctacagtagacaaagacgttacatgaagtctctggaaattccctgtagaagcgatacagcacagaaccctagaatcctggagcaaggccatgtcatctgccagatgaaagtatacaccattcgaaaagcagcacctttcatgctaggggaccctgaccctggtgaaaactgagtgtctcacatgggacatcaagtgatgctgacaccagaactgcctcttaggagccagcaaaccaccagacatactgttggtgattccagcaggattccaccgtatgatgggagggagcagtgtgtttgagatcaggcttgagctagtacagaggccacaagtgagctgtcaaacccagccacccagacccaatgctacctaaccctcctgcgctatactgaacagcatcccccaaattcatgtctacatcaacctccgactgtgactttatttggaaatagggtctttgcagacataattagttaagattgggtcatactagattagggtggccctaaatccaatgaatggtgtccttacaagaaggccatgtgggggccaggcacagtggcttacacctgtaatcccagcactttgggaggccgaggtgggtggatcacttgaggccaggaattggagaccagcctggccaacacagcgaaaccccatctctactaaaagtacaaacattagcctggcgtggtggtgcaggcctgtaatcccagctacttgggaggctgaagcacaagaattgcttgaacccagaaggcggaggttgcagtgagccgagatcgtgccactgcgctccagcgtgggtgacagagcaagaccctgtctcaaaaaaaaaaaaaaaaaaaaaaaaaagaagaagaagaagagaaaggccacgtagagaaggaggtagaaatgggagttacgctgccacaagacacatgaagaccccagaaactagaggaagcacagcattctcttctagagcctttggagggacttttgccctgttgtcaccttaatttcagactttcagcctctagatctgtgagataataaatttctattgttttaagccatccagtttgtggcacattttatgagagctctaagaaaagaatatgtgcaccatcatccctccctcatctcacactgatggccagaggacagagagaaaaaatggcctggctcaaagatgagtcagtggagtatgttgatcccagctaaaaataggctactgctacttgacagatctacccgaaggtggccctgaaagatggtgatgaggaaaaagtcctcccactgggccaagcactggacacagcacctagtgatacctttgtatcgagaagaacatggttcaaggtcagtgtacacatggaatcttaggcataagcttttgggttgtggactctcagaatggcttttgctggtttgttaaggacatggaaggaataagtttgaaaaatgggaaccaggaagtctagggaagagacatacatatggatagacctggggaagaggacacaaactatgaagatctttgcattgcatggcagaagaggcattcagcaaggaggcagaaagtatggcacagccaactgatgctagccagcctcttcccttgccaccccaacacctgctaaaacgcccatgaatggagcagcccctatggcacagatggaggctctggatggaatgtgtttcctctttctgcgacaattttcttcctggtatctatatgcttggctaactctctctctcctggacaaataccccttctcagtgagacacagctgcaaaggcacattgatctgggaagctagagaagcttcagttttggggtacataattcccacaggccctgtgtgtgctagaagttgctcatagttgtacaacatggataggtgaggccagtttatgattagaaagcatttctatgtcagtattcctgggaaattgcctaatcagaacatagggacctgtaatgccattgttacagtaattacttgcaatcttttctaattctaaatacatattcaaaactctgatttcccttcagctggtataaatctttcacctattgtcaaatattaactttagggactaattttgtgctccaagtttgtgttgtttttttttttttttttttttttgagacagagtcctgctctgtcgcccaggctggagttcggtggcgcgatctcggctcactgcaagctccgcctcctgggttcacgccattctcctgcctcagcctcccgagtagctgggaccacaggtgcccgccaccacacctggctaattttttgtatttttagtagagacagggcttcaccgtgttagccaggatggtctcgatctcctgacctcgtgatccacccgcctcggcctcccaaagtgctgggattacaggcgtgagccaccgcgcccggccccaggtttgtgttttttaaggaggagggcccttcaaattgtataagctttgggtcccacaaaacctggctgctcctgcctgtcgcagttacttcatggaacactattcctgccccatccctgcatcttggcacccgatatcacttactctgcttcaatttttttttctttttcattgcactcatcgccttctaacatactatctgtttatttctgcttgttgctcattatctgattcccaccattaaaatgtaagctccaaggagcaggcatcttagtgttggctgatggaaaaaccaaattttatcaaaatattttaagaggtttattctgagccattaggagtgatcatggtccggggctacacaatcccaagagttcctgagaaagtgtgcccgaggtagtcaggttacagtttgcttttatacatttctgggagacaggaattgcagacaatatcataaatctatacacagaagggatacattggttcagtccaaaatggcgagacattccgaaataggggcttacaagccataggtgggttttagggattcttttgttgacaattggttgagagatttaagctttgcctaaagacttggaaaggaatgcctgagttaagataaggaggtctgctcctgtcctgtgatgctataccagaattaggttggaaagtaagccacattacaccaggttaactttttaaaatccatttagctgggactacaggcatgtgccccttgcctggctggtttttgtatttttagtagagatggagtttggccatgttggccaggttggtctcagactcctggcctcaagtgattcactcaccttggcctccaaaaatgctgagattacaggtatgagccaccacacctgtccaagcctagagttttcaatacatcagttgggtgctgggttttaggataatttggaacttaagcaacctcattcggaaagatagatttctgtatttaatagtaaacatgaatttgaaatacagatttttccatagggaagaaagttctttttaagaaaaacaaatctgtttaacaagagtttatggtttatggggtttaactccccaggccccttatataggaatttggacaggagaaaaaagatcagagttcagtcctcagggttatttatagattccctgtgcctagtagagtgtgtgcttatactgggtacccaataagtatgagtagatgaggagaaagaagggaaggagggggtgatgggggaaggaagagagaaagaaaaggaagaaagcaagagcagatggaatgatggtgctcgggacccactatcccaaaatatgactagaggagaccagaatatgccaccccaaaatacacctctttggcacattgattattttgagctggttattttgagaaactgcagacataagttcaactctgaaaagttgttcttctgtaaaattaatttacatctataaaggacctctttccacctggtgggatgctccctctctgcaccaggaaggaaaggatggttagatctccagacactcttgagcagtggtgaaggcatcacctgaaatctgcgtaacaagccttgtctttatttaaggagcttttcttggccatctctttgtttcagacaagggacagcatttaagtccgaagtttagactccttcttggagagctagtctagagattcacttctctgtttttttcccactgtatacatgaggtacacatgttaataaacctctattcatttttatcttgctaatctgtcttttgttacaggaactatgaactaagcactgtagttcagaactataaagggtagagagaaaattcttttcctcccttctggaggacacaattaagagccatagcagccagaaatgccagccagagctgataggactcaaagcgaggggtgtctattggccctggtcagccaaaataatagaccacaaattcatgagccacaagtgtcaccagtgagtgccatctgtgcacagggagcaggtaactagagacatcaacaatgaggcaagcaatcatccagaaggcagcacaaggagctgggcttggggacctgaggcccccatctcctcaccaccctgagacggccctcactaagcatctatatccaaacactgtcttagggaagagaagggaaaggggaaaaccttggaacacccgaacatttacctggactagagtattcaaaccagaagagatagctttacttggcaagccgtttctcctcctcccacaagcatcctacatacacagactggaagtttgagaacaagattatatcaataatagaaaataaaccatgtgttctttgggcttctgagtagtagtagattgccttttaaggactaagtaaaactaatgatagtgttaaagaaaaattatccaatgatgcctcttaaagtgccataaggcagactttattcaggaccattgtgatcgtcttgggaccgctacaatggagtcttgctatggtggggagaaattggcctcgactctgaacatagcgtgggcaagtgaacttttggccaaggaatggtggggggtggtcagtggatagaaaattactaagaggaaatgtcagggtaagggggattctggctaacctgacctaataggattcttgcagaaggcaagccagggcaatcagacatcatctgggggctgatggaggatgaggaacccgatcagatatcaaggatgatcagatacggagggtgggaggttttggctaactttacttagaagggctctttttctaaaactggattttacaaggaagtacacagatgggcctaggaaaaggctcttgagcaaagcttggccaagcccagaatctttgtgaacagaggaacacagaataactggtggtatttcagtatgttttattctaaaaggtctgagagcatccaccaaaaggaggtgtgccgtcaatattgtggactattttataacatgtctttttttgtatttttacttgcatgttgcttacttttgactaatgacaacatctacaaaataagagacacctggcgatttttattgtgcatgtgtttacaaaatcttgcttcaaatgaattatatcatttatagcactttgtcatgcaatcttatggcatgcagcttctgctgtattaaaaattagattaaattaattggacttttaaaacatttgttaaacaaagtaatgaagtataaataagaatccctaataaatatctaatttatactccaggcccaggttcgggaatacatattgtgtaggcacagacacagacacacacacacacacacacacactctctctcacacacacacacacactctctctcacacacactctcacacacacacgcacacactctcacacacactctcacacactctctcacacactctcacacgcacacactctcacacacacactctcacacactctcatacgcacactctgtcacactcacacactctcacacactctcacactctctctcacacgcacacacactcacacactccctcacacgcacacactctcacacgtgcacacgctctgtcacacactctctcacactcacacacactcacactctcacacactctcacacattcacacacactcactctctcacacactcacacgcacacactctctcacacactcacacgcacacacgctctctgtcacactcacacactcacactcacacactcacacacactctcacacacacacactctctcacacacacacacacacacacacccttagccttagacgtgaaaaagcgtcttgtctggaaaaggaacacatctatctgaaaaagaggctggaaatatgaaattttttttctggaataaataaaatcccactttgccttgctcccttcagaatgtggtggaaagcctttccacttaggcaagggctaattgctcaacagaaaatgccaatgaagctcattgtaatgggattctatccatctgtaatttccattcctagaaccaaatactttcatctgttcccatgtcttccaaaacatgagtacccttggtggtaaagggaagcatctacagattgtcatttcatttttgagagccattcagaaagaaagaggcatactacaagcctgggactaagaacagattgaattcattaaaaagacagaagccaaactgttcatctctggtacatgaaaaatcatcactgttgttgttaaaaccatatgctttaggtaagaggacaggttttgtattcgctctaacatttgttctgaggaatgttgatgtacttaatgctagtatgtgcttagcagtaatttgcaaatatgaaaagtaaccaagagttcaagcaatgagtaaggagggtcagaaacctcatctgagatatttcccagttatcattgataatatcattgaaatatcatcgtatatcatgtccgaatgttagagcatagacaaagatctacgtcatcatttgtcatcatttcatagctttcggcatgcaggctcagactttaaaagagtttgtttcctccttaaaaaaaaaaaaagtcttaaatttttttaagtttccatgcggtgaaattggtagaggctttgatcacttgacctgaaatgatactgatttgtgtctttcagctgaaactctgctcagttccccagaccaggtttaaaaaaatgcaacaacccacttaattgatgtatagcatatgaagtatacatgaagtatagcaatgtgcactatatagaaaatcataaagtgttcagcttgatgaattataaccagatgaacacactcacaatttatgtatccattttatatctgatgggctttggttgtttctagttttggctgactaatgttataagaacattattgttcgtgtcttttgacacacgggggtatgctttgctgttggttccatagctaggagtgaaattgtttggttacagagtacatacatatattcaattttaatagataatgccagtcttacaaagaagttgcaccaatttacattaccaccaggcatttttgggaattatagttgctcatatctcttcctattccttggtagcatcagcctttttaagtttggccatttcagtgggttgtatcccattgtgcttttaaaatttgcaattccctgaaaacttataaggttgaatatcttttcctacattttttggccccttaaatatcttcttttgtgaatagcctaatagaaaattgtgcccacttttctagtgtgttgtttatctttttctttttgatttgcaggaattctatgtaaattctggaaacaatttcttcgttagcaatatgcattccacatattttccctttctgtagctttaaaaactccctcaatagatattttgatgaacagaaagtcttattattaggttgtccgatttatcaatctgacttaatgttatcgccttttctgtccaaaaaaactttcttacccacaggtcatgaggaaatgctcctatgttattttctaaaagctttttatcattttacttttcacattgcacagtccacctagaattgatttctgtgtatagcgtaaagtaagagtgaagttttcttttattcttaaagtagataaccaatcaatttagcacccattattgaaatgactgtttttccaccaggtctctgcatttataaaattcaagtgtccgtatatgtgttgctctgtttccagactctctattatgttccactggtctatttatccatttgtaccaatcccacacttagtgcaattactgtaattttaaaaattactgtatcgttataggtctttctatagggtagaataatttcctctcattcttgggtttggctgtttttggtcttttgcatgtccacatacattttagagtcagcttgtaaattgcaatgaaaattgtggggcttttaattcaaattgtttagaatctataagttagacggaagaattaacattttgcaatattgagtcttataatctataaaaaaaagtacatcaataaacagtaaatctataggtctagtatttccttcaatttatttagttttcatttgtgtttaattattaataatttaatttagtgatatattttcaatagatttttacatatgtcttgaacattttagatgtatttccaaatatttcctttttgatgatattataaattataacttgtaaattagttttattggtttgggatatataaaataccatttattttttaattgaccttggatccaatattaataaatgtacttattaattctaacagtatatctgtacattcttatagatattctacatataaaaatcatattgtctgcaaataatgacagtttcatattttcctttccaaattgtgtatttctatttttttcatcttcccttgttgcattggctaagacctacagaacactgttgaataggaaaggtgataatcggcatttttgtctgtttcccagtctcacagggaaagctcttaatgctgcgccattaaacgtggtgtttgtttcaatttttaaaataccctttcttgaattaaggagattatttcaattcctaatttgctaaaatttttaaaaatcatataatggatcttgaccaaatgcttttctgcacccacctcagcctcccaaagtgctgggattacaggtgtgaacaaccgggcctggccacaatatttcaactttatgatggcacctatgtaaccattctgtttatcactttcagtatagtatttaacaaattccataagttatgcaacagtttattataaaataggctttgtgttgtatgattttgcccaactataggctaatgtaggtgttctgaacatgtttcaggcaggctagactaagctttgatgtctggtaggttaggtgtataaaattcattttcaacttacaatgggtttcttgggacacaactccattataagttaaggagtctgtatttgccaacaacagcactaaagatgtgagtgggaatattggagtcaagaattgacaccagatgggtaattcaaatccacaagaacaaatgaagagaactagaaatggtcaattggtagattaatataacagatgctatgaatatatacttgccttcttctctcagcttctttaaaatacataaaatttaaagtaaaaacagaaaaaaattagatacatataattaaatgttataattacataattatagcaatgtattgttgggtttgtaacatttatagatgcaatatgtataacaataatagcacagaagggtgggaaagagaatggagccatacagaagtgacatttatatatctaattgaaattaagttagtataagtctcatgtagaatctgaagtaactcttgactagttaaccaatatatcagaaggcctagaccaatcactaagaaaatagcttaacatagtgaaaaaagtcattagaggaattaaatcgtaacacaagcaaatgtttgcttactgtaaaataaagcagtaaaggagggataaagaaaataaagaacaaaaaagacatgagacacagaaaacaaaaagtaaaatggcagacataaacccaacgatatcaataatattacatataaatgaactaaacaacttaatcaaaaatcagaaattgttgggctaaactttttttaaaagatccaaatatatgctgtctataagaaacacactttagactcaaagatacaaatacactgaaactaaaagagatagggaaaatatgcaaatagatagaaaaatatgtaaaagacagaaaaccatttaaaaagcaaccataaaaaagctggagtggctgaactactatcagacaaaatagactttaaaacagaaaatgctattagagataaagaggaacattttataataataaaaatgtcaatccatcaggaagatataataattacaaacatatatacctaacaagagagccccaaaatacataaagcaaaaactgagagaaatgaaggctgttatggactgaatgcttgtgtcccccataactcatatgctgaaactccaaactccaaaatgtgatggtattaggagttggggcctttgggccctaacttaggtaatgagggtggaaccctcatgaataggatttgagccctagtaaaagacaattcagagagctagtttgctcttttcctgccattgaggaaaacaacaagaagttagttgtctgcagtctggaaaggcccctatccagagcttgacctgctggcccctgatttctatttccaacctccataactgtaagaaataaatttctgttgtttataagtcatccagtctataatacgttgttataacagcttgaactaagacaggaagaaattgacaattgaataatactatttggagtcttcaatgccccactttcaataatggacagaactaggcagaaggtaggctgggcgcggtggctcacacctgtaatcccagcactttgggaggccaaggtgggtggatcacctgaggtcaggagttcaagaccagcctggccaacatggtgaaatcacgtctctacatctaataatacaaaaattagctgggcatggtggtgtatacctgtaatcccagctactcaggaagctgaggcaggagaatcgcttgaacccaggaggcagaggttgcagtgagccaccattgcactccatcctgggcaacaaaagtgaaattccatctcgaaaaaaaaaggaaaagaaaaagaactaggcacgaggtaaacaaggagatagatacttgaacaacaatataaaccaaatagatcaatgctcatctgtagactacaaccaacaactgcagaatacacattcttctcattctccagaatagaccatatgctaggttataaaacaagcctcagtaaatttaaaacgaataaaattattaaaagagtatgttgtcagactaaaatgtagtcaagttagaaaacaatgacagagagaaatttgggaaactcacaaatacatggacttaaacaacacactcctatataaaaatgaatgtgtcgaagaaaaatcagagaaagtattagtttcttagagctgtcataacaaagtgctacaaactgagtagttaaaaaacattattatctcacagttccggagtctggaagttcaagaacaaggtgttagccaggccattctccctctacagatgctagggaaggatctattctagtttaaatgggtgaattgcatcttatacggctattacaaaaaatgtattgtagacattatgatatttttaacctaaatactttagaatgtaccttctaagaactgctactaagaagttctgtaagtaaataaatgggcatttcctctgatccacagttctagtgtttctgcatgtgtgcatatgtgtgtgtgtgtgtgtctgtgtttttgtgactgtgcaagtagggtaacatctcagacccttcactgtttcagagccaatagtacatagaacccttctgtacgttgatccaagatacagtgcagactttctcaaaagactgtccaagaccgtctcttgcccagcttctggtagttttttgacttatggctaaataactccaatcaccgttttccctgtattcatgtctgtccaaaattctccattttataagcacactagtcatattggaggcctggcccgccctactccactgtgaccttattttaactaattacatctgcaatgacccgatttcccaataaagtcacactttagacacagggacttaagacttcaacataggcatttggcgtagggggtacacaatttaacccataacacaaggggaattatgaaacactttgggatgaacagaaatgaagacacaacatatcaaaatttatgagatacagttaaaactgtacttagaggggactttatagttgtaaatgcctgtataaaaagtagaaagatctcaagtcaataatttaaacttccaccttaagacactgggaaaagaagagcatcctaaatataaaccaaacagaaagaagggaatcatgaagattcaagtggaaattaatgaaatgaagaatagaaaaacagtgaaaatcaataaaatcaaatgctggttctttgaaatgaccaaaaaaattgacaagcctttagcgagattaatcaagaaacagagagaagactcaaattactaaaatcagaaatgaaagaggggacattactgccaaccttaaagaaataaaaataattataagggaatactatgaacaactgtgtctcaataagttagataacttagatgaaatagataaatttctagtaaaattgactcaagaagaattcaaatggcgtgtataataagcaaaaacattgaattagtaataaaacgtttttaaaacttcccacaaagaaaagctcaggcccaggtgcttcactggtgaattctaccaaacatttaaggaataattaacagcgattcttcccaaactcttccaaaagaacagaaaagtggggaaaacttcctaaatcattctatgaggtcagaaatactctgataccaaaaccagacaaaatttcacatgaaaataaaactacagaccaacatctcttatgaatataaatgtaaaaatcctcaacaaaatattagcaaactgaactcagcaacatataaaaggatcatacaccatgactaaatgagttttgtcctaggaatgcaaggttagtttaacattcaaaaatcaattgatgtaatacacttaatcaatagaatgaagggcaaagaccacacagttactcaataaatgcagaaagaacatttgacaaaatccaacaacctttcatgatagaaacactcaactgcaattctacccctaggaaaaataaaaacatatgaccattcataaacataaacaagaatgttaatagcagcattattcttcatagtcaaaaagtgaaaataatccaaatgtccatcaatcgatgaatgaagaaacaaaatgtagtatatctatacaatggaatatgacttatcagtgagaaggaatggcatactgatacatgctacaacatagatgaccttgaaaacattatgctaaataaaagaagccagtcataaaagaccacatattgtatgattccattcatataaaatgtctagcatatgaatgtctctagagactgaaagtaattcgtggctacctagggctagagggggctgtaaggattgagaggtgatagttaaagggtataaagtttattttggaggtgatgaaaatgttctacaattcattgtcttgatgattcatgattctgtaaacatgcaaaaaaagtaaataatttaaatgaatgaaaatgtataatttaaaatgtagaatttaaatgaatgtgaaacgtataatttaaatgggtgaattgtatcttatatagctgttgccaaaaaatttattgcagacatcatgacatttttagtctaaaaatactttagaatgtatctcctaagaattggcactaagaagttctctaaagaaataagtgtttattttctctgatccagagggctagtgtttctgcttgcgtgggtgtcttgtgtatgtgtgtgtctgtgtgactgtacaaggagggtgacatctcaggcccttcactgtttcagagccagcagtacatgaaacccttctgaacacttacctaagatgtagtccagactttctcaaaagactgtccaagtgatgatggcatttttcagccctcctcagtaaatgactccatttatttgggtgtgcccaaatgacaccactcttggaaaagaaatgagataaaaaataacgagtaggtcaggcatggtggttcatgcttgtaatctcagctctttgggaggtcgaggtgggaggatcacttgagcccaggagtttgagaccagcctggccaacatggtgaaaccctgtctctacaaaaaaataaaaattagccaggcatgatggcacatgcctgtggtcccagctactcaggaggctgaggtgggaggatcacttgagtctgggaggtcaatgctgcagtgagctgagatcatgccattgcattccagcctgggcaacagagcaagaccctatcttaaaataataataataataatattaataatgtgtaaaattttctcctcacttgctgtattagtccattttcacactgctgataaagacatacccgagactgggaagaaaaagaggtttaattggactcacagttccacgtggctggggagacctcagaatcatggctgaaggtgaaaggcatgtctcacatggcagcagataagagaagagagcttgtgcaaggagactcttgtttttaaaaccatcagatctcatgagacttattcactatcatgagaacggcaatgggaagacctgcctccatgatttaattacctcccaccgggtccctcccacgacacaggggaatttaagatgagattcggatggggacacagccaaaccatatcacttgcctaagagaaaatctctaaccgtagacttgtctttctatcattcctgtcagcctgagttgctgaatgacatgtggaggagagtcacctgccaacccagaaaacaagctctgaactcagactcgaatgcaaattagacggctctcttgttggcctcaccacatttttgtgtcctgcactatagcaggaagtgcaatcctaacggagtcgtctttagactcacaaaggaagagagctgctcttctgtgttctccccacattccctcctccagtgcatcttcagagagataaatccctcctctgaagctatggctcctgatattcatcagtttgcaggaatatttacctcagaagccaggaggatttgcagctgctacctgacaaggaaaaggacctcgtggctggcacccagccatgctcctccacttaatcttcgactctcctgccacacccgccttctaggggatggctccttcctcatcttggcaagcctatgtctggtctcccatagaagtgggtgctgggcactgccactcttactgtgacaacaggctaaaatcagtttcccaagcaaatataccacgagtaaatattgattctagacctcagtatttcttctttgaccgttatatttatttaatcctgcatgtccgcaagcagatttcgcccatgtgcacaggctaactgagctaattcccgtggtaccaggagggcttcttgacaagtcttcattgacaaggagacctcaggctccttcttctatcacaaaaaaggggaagtggttcaatgtggtggcgcagatatgtaatcccagcactctgggaggctgacacaggagaattgcttgagcccaggggtttgagactagtctgggcaaaataaccagctcccatctctctaaataataaaatttttaaaaattagccaggcaggctgggcgcagcagctcacgcctgtaatcccagcactttgggaggctgaggtgggtggatcacgaggtcaggagatcgagaccatcctgtgaatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccacagcactccagcctgggcgacagagcgagactccgtctcaaaaaaaaaaaaaacaaaaacaaaaacaaaattagccaggcatggtggcacgtacctgcaatcccagctgctctggaggctgaggtgggaggatcgcttgagcccaagagtttgagactgcagtgagccatggttgtgccactgcactctagcctggggacagagcgagactttgtctccccctgaaggaaggaaggaaggaggaaggaggaaggaaggcaggaaggcaggaaggaaggaaggaaggaaggaaagaaggaagaaaggaaggaaggagtggggatgtagggaggaaggaagggaagggagagaaggaaggaaggaaaaagggaaggaaaaaggaaaggagggagggaaaaaaggaaggaaaaagggaaggaaaaaaggaagggagggagggagggaataaaggaaggaaggagggagggagggaaggaaagaaaagaaagaaagagagagaaagaaagagagaaaggaaggaagggagggagggagggaataaaggaaggaaggagggagggagggaaggaaagaaaagaaagaaagagagagaaagaaagagagaaaggaaggaagggagggagggagggagggagggaaagagagaaagagagagaaaaagagagaaagaagtggaagtaccttcacttttcaaactagcatttggcttaggcttagacgcattttgaaacactataggattttcatggaagactatttttaaactatctgagcgtcggcaagaaggatgggtgcttttgaatatgtattcttattactagaaagtttccaggattgctgaaattacattacagtcttaaaatcctttttatttgtttatggacaaaaatggcttagatagtcagaatccaacataaagccacatgcaactatatttcctaatattaatattctgtggaataaggtgacattagaaagagattagttcctgctatgtaatacatgtttttacataaacgaatgtctgatcctagagtttcacggcagaactttaggggtgcaaatcagaaaagcacagcatagattcatcttgcctcttcctgtgtgccctaaacaaactgtaaccttgaatcatgatttcattatcatagacagtagaattccatcaaatatctgtagcaccaactatgtcaaagttatgaaggtaaaaccgaattctcagtttacatgtttcacgcaataatctacaaatacatttcttcaatctccaaaaacttataaatatttaatgccacagaggcttttcaaatgctcaggtgagaataaggcatgtttgctttttagactaaactttagactgaaactcataaatcacaaggactgtcagtgaagaccacatagtcatctttcctttagtctaaacaaaaagccctgggaatgggcctcagaagaaaaatctttgaagatgtgtagagaagccccaaaatatatttctgtgcatctctataattcgtgttatatctacctacagctattgcataagttgtatattatatatcacactagaggctttttaagaggtgatatttctcctgcatataagtgtaaaacaagccattttctgcagtcaataagttactagcttctgagacccataagagaaattctgaattgacaattttcctccagaaaaggtaggaaagaagaaccctggcaagtaataatttaataatttttcttctttataacactcaatacatccagtttttttctctaaccaagatctataaatacaataaaagtaaatgctatttcatcacagaacatattttatatatattctggctaaagatcaaatgcaatctaattttcacaataagtggagaataattggcaaagtcatgtgtcttatcattttattgggttttatgttaaagacagaaaaaaattgtaaaggaaacaatttttatgaagtctatcaacactaaaaaacgtgcttgtaaaacctggatctggtctgaaatagaatatgtgaaaggcaagttcatgaaaatgcatgaattataaaaatgtttttcattgctggtaggtagtcccaccagaaacccattattaaattaataattaacccggaaaagagaaaactgaaaacaaataaagtaaatatgtagcacttaccgaccaataccagacaagctgagtctgaacaattttctagctgattctgctcccagcttttccacttggaacatagcaatcttaagcgggatgctcaggcaggagcttctcaggcaaggggtctttatcctacaggagctctgtaccatggcacctaatgaggtttacgaaaagagttgataagacaacctaccctgactttgtagtgagaacttggagcctgggcttggtgtttcatgcttataatctcagcactttgggaggctgaggcaggaggatcggttgagcccaggagttcagggctgcagtgaagtatgatcgtgccactgcactccagcctgagcaacagagcaaggcaccgtcttaaaaaaggaagattgtggctgggcacagtggctcttgcctgtaatcccagcacctttggaggccgaggccgccggatcaagaggtcaggagatcgagaccatcctggctaacacagtgaaaccccgtctctactaaaaatacaaaaaattagccaggcatggtggtgcgcgcctgtagtcccagctgctcaggaggctgaggtagtagaatctcttgaacccgggaggcggaggttgcagtgagccgagatcacgccactgctctccagcctgggtgacagagcaagactctgtcttaaaaaaaaaaaaaaccagattgtacatttattattaatttgagcatcaatatgtacaactttgaggaggctctgtcagtcctatcatcaacttctagttcctccatactgaaaatcctggaatgggttttctgtttatttggcttggcaactcagtctctgtctgtctctctctctgtctctctctctctctctctctctttccttcccttacttcctccctccctgccaaatctttcattctgccaatgatcactttgaaataatcagctttactctgcaagctacaatgataggaaggcggttgaaatcccgttgtgggagtttagtcatctcagattcaggatctgagttgaaaatagaatttctgttattgctcctggctcatttaagcactactcagaaaatatttgctgagctaggcactctgttctagtcactcaggatatagcagtgaacaaaaaagtccttgctcacacagaacttgtattctagctgggagagacaagagagtaaacaaatacgtaatatcctgggtggttggaaacgctatgaagaaaaataaagcaggggagggaatagaacatcaagtgcaggggctgaggtggtttacaatggactggtcagagaaggctctatgatgcgttgacgtccgagcagagagctgaagaagagcaggtgagtcaggcagattcaggcagagacccaagcactggggagagcaagtgcaaaggttcgaaggcaggcatgtgctagggtgttcaaggaacaagaaggaaatcaaaatggccgacgcagcgtgaatccggggaaggagggggcaatgaagacggcaatgaatgaagaagggaacctggagccaagtaatggcgggacttagacaagggcaggcatttagggctttactctgagagaggtgggaaaccagctgagaatcttcaacaaaggagcggcacaatctgacttctgttttcagaagattaccctggaaggtatgtgaaaaaatagattggagaattacgaggatagaatcagagagatgaattaaaaggcattgtaacgctgccatttttaaccatattggagtaaatagtgctggccttgccctcctaccgtcaacaattggaaaactgaacaacggtatgaaacgcttcatatcaaattcaaattttctatcagacttagacactggacaagcgatctcacaggactttgatatgtgataaaaggggggaaaacagggtaagtcccacctcagctgtctgcctggaggtattttttggactgtgctgcagggagagagaatccaagcaatacatggggatttcattaagtgagacaagggggcctcaagtagcaggaatttgccaggcagaatactgaggggtaggatctgtacagataaagagatatagaaatcaacagagggattcccttgagcctattgctgaatattaatatgtccatggatgggtctggcaagggtctcctgggaagctgtaagccaaacaattctcagagctcactttgggctgggagataatgaaaacatgccagccaggcacagtggcttatacctataatcccagcacttttggaggccaaggtttgcggatcacttgagcccaggagttcaagaccagtctgggcaacatggtaaaaccccatctctactaaaaatataaaacttagccaggtgcggtggcatgcgcgcgtagtcccagctacttgggaggctaagcagggaggattgcttgagccctgaggcaaaggttgcagtgagccaagattgcattccaccactgcaccccagcctgggcaacacagcaagattgtctcaaaaaaacacaaaaaacaaaaaacaaacaaacaaaaccccatgccaaccagtgtggaaaaacctcactaacgtctagggcattattaagatgatgctttagatctggagctaaactaggcctagagcaaggactattgttgatctaccccagcaaaagcctgagacaagccccaaaaggtgaagtggaactgtgagtttcttaactacctgccaaaataaatgtcaacacattttaaagaaatttagcaaaaccaagacatgaacaacatactattcaaaattttcagcatccaagaaaaaattgctagacatgcaagagcagaaaacagtggctgaaaaccaggagaaaaatcagtcaataagaagctaaaaatatagtggccccctcttctccacaagggatacattttatgaccccccccaccttccgcggtggatgcctgaaaccatggacaataccaaaccctatgcatactatgtttttacctatacatataaacctatgagaaagtttaatttataaattaggcacagtcagagattaacagcaataactaataataaaatagaacaattatagtaacgtactgtcatacaagttatgtgaatgtggtctctctctctctttctcaaaatatgtcattttactacactcatccatcttcctgtgatctgccaatctgataactgagacagctaccaagtgactaacaggcaggcagcatataaagctgagatatactgaataaagggatgattcacatcctgggcaggacagagcaggacagtgggagtttccatcatgctactcagaatggcacacaatttaaaacacatgaattgtttacttctggaatttcccctttaatatttttagaccacagttgaccacgggtaactgaaactgtggaaaataaaactggatggcggcggggggaaccactgtagaaggcaaattaaatgaaagtaagtagaggaaagggaataataaagataagagtataaattgatgaaatagaaattgacatccaatagagaaaattaataaatcccaaagctagttctttgaaaatatcagcaaagttgataaacctatagttaaattgccaaaaataaaaatggaaaaggacagaaaactgtttgggccaaattgtgtcctcccaaaatccagatgtgaaagccctcatccccagtgccattgtatttggagatagagcctttaaggaaataattaaattaggtcataagattgaggccctaagcaaaaattagccaggcatggtgatgcatgcctgtaatcccagctactcaggaggctgaggcaggagaatctcttgaacccaaaggcggaggttgcagtgagccgagatcgcaccatagcactccagcctgggtgacagagccagacactgtctcaaaaaaaaaaaaaaaaaaaaaaaaaaaaaaaaaaaaaaaaaagattgaggccctaaaccattagcactagtggccttacaagaagaggaagagacgccagagctctctctctttctccacacatgcatagaagaaaggccctagaaggacacaggagaaggcagcactctgcaagccaagagagccctccccagaaaccaaattttctggcaccttgatcttgaacttctagtcgccagaactgtgagaaaataaatttctgttatttaaaccatccagtctgtggtgttctgttatggcagcccaagctgttaataataataatgataatacatatttcagtaccaagaaacggagtgccactgtaacaaacacctaaaaatgtggaagtgactttggaaatggataatgggtagaggctaaatgaactttgaggtgcatgctagaaaaagcctaatttgccatgaaaagactttagtagaaatacggatgttatagtctggtgagagctcaagaagaagagaggatagctgtagagaaagtgaaagcttttatcatcttagagaatatatatcatcatgaatagaacgttaatagaaataagacattaaatatgccccgggtcagaaagagatcatcatggcggatggcaggcaggaccagattgcagctccaactcggacagacagcagcgtgcggagcctcgcatcatcaattccagctccagaaccactgcagaacaacccagcaatcctgagaggacccacagatcctctgaaggaagcaggctgctcctgcaggaccgggagacaccccaaatactgtgagtgcccaaactgcgaaagtgagaaagggagaccctccaccccaaacacacacccccactggggaaacgaaggtctagtttgcaggagaagtttctgaccttacctggagctgagtcaattcagagctgagcaaaatacaggggtagaggaagcaacgggaaaggccctgggagctcgctgggtccccaagcaggacattgctgcctggcgccacagggatccttcgggatggcggccagaggcgcgggggaaaatgtcacagggagaaggaagtctccagctgaacttagtaacaattttttttttttttttttttttcggacggagtcccactctgtcgcccaggctggagtgcggtggtgcgatctctgctcactgcaagctccgcctcccgggttcacaccattctcctgcctcagcctccggaatagctgggactacaggcgcccgccactacgcccggctaattttttgtatttttagtagagacagggtttcaccgtgttagccaggatggtctcgatctcctgaccttgtgatctgcccacctcggcctcccaaagtgctgggattacaagcgtgagccaccgcgcctggccactttgtaacaatttgaactggatgagaagccccctggccagaactcgggggagggtgcaaatccgatgtgcagactccacaagcaggggaagaaccaaagcccttttctttcacagctgggaggcaggtaacctggggcaagttctcaagccctgctcgcccactacctggaaacagactcggggctgttagggggccatagtggaagtgagactgaccctttggattgcgtgggagctgggtgaggcctgtgactgccagctgtcctccacttccctaacatcctgcatgactcagtagaggcagccataatcctcctaggtacacaactccattgacctgggatcacctgggaacctcaccgccaacccccacagcagctgcagcaagacccacccagtgagagtctgagctcagacccacctagccctggccccacctgatgggccttccctacccaccctggtagctgaagacaaagggcatacactgggcatatactcttgggagttctagggccccgcccaccaccggcttctcaccatactaccacagctgatgctctctggaaagccccacctcccggcaggaggccaaccagcacaaaaatagagcattaaaccaccaaagctaagaaccctcacacagtccatttcaccctcctacaacctccaccagaacagctgccggtattcacagctgagagactcatagattattcacatcacaggactctcttgctggggggctagacccagaagagagataacaatcactacagcttggctcacaggaagccacatccataggaaaagccagggagtactacatcaaggaaaatccctgtgggacaaaagaatctgaacaacagccttcagccctagaccttccctctgacagagcctacccaaatgagaaggaaccagaagaccaactctggtaatatgacaaaacaaggctctttaatacccccgaaaaaatcacactagttcaccagcaatggatccaaaccaagaagaaatccctgatttacctgaaaaagaattcagtaggttagttattcagctaatcagggaggcaccagagaaaggcaaagcaagaaaatccaaaaaatgatgcaataagtgaagagagaaatattcaaggaaatagatagcataaagaaaaaacaataaaaacttcaggaaacattgggcacacttatagaaatgcaaaatgctctggaaagtctcagcaatagaattgaacaagtagaagaaagaaattcagagcttgaagacaaggtcttcgaattaacccaatccaacaaagacaaagaaaaaagaataggaaaatatgaacaaatcctccaagaagtctggaattatagtaaacaaccaaacctaagaataattggtgttcctgaggaagaagagaaatctaaaagtttggaaaacatatttgggggaataattgagtgaaactttcctggtcttactagagacctagacgtccaaatacaagaagcacaaagaacacctgggaaattcattgcaaaaagatcatcgcctaggcacattgtcatcaggatatctaaagttaagatgaaggaaagaatctttagagctgtgagacaaaagcaccaggtaacctataaaggaaacctttcagattaacgcagacttctcagcagaaaccctacaagctagaaatctttgggccctatcttcagcctcctcaaacaaaacaattatcactcaagaattttggatccagtgaaattaagcatcatatatgaaggaaagatagtctttttcggacaaacaaatgctgagagaattcaccactaccaagccaccactatacgaattgctaaaaggagctctaaatcttgaaacaaatcctggaaacacatcaaaacagaacctctttaaagcataaaccacacagaacctataaaacaaaaatacaatttaaaaagcaaaaatgaaaaaccaaaaaaccaaggtacacaggcaacaaactgcatgatgaatcaaatgataccttacatctcaatactaacattgaatataaatggcctaaatgttccacttaaaagatacagaaccagctgggcacagtggcttgtacctgtaatcctagcactttgggaggacaaggcaggtggatcacctgaagtcaggagtttgagatcagccaggccaacatggcaaaaccctgtttttactaaaaatacaagaattagccaggcatggtggcacatgcctgtaattccagctactcaggaggctgaggcaggagaatcgcttgaaccaaggaggcaaaggttacagtgagctgaaatcatgccactgcattccatcctgggtgacagaacaagactccatctcaaaaaaaaaaaaaaaaaaagatacacaactgcagaatggataagaactcaccaaccaactatctgctgccttcaggagactcacctaacacataaggactcacataaacttaaagtaaaggggtggaaaaaggcatttcatgcaaatggacaccaaaagtgagcagggttagctatgcttatatcagacaaaacaaactttaaagcaacagcagttaaaagagacgaagagggacattatataatggtaaaaggccttgtccaacaggaaaatatcacaatcctaaacatatatgcacctaacactgacactcccaaatttatagaacaattactaatagacctaagaaatgagatagacagcaacacaataatagtgggggacttcaatacgtcactgacagcagtagacaggtcatcaagacagaaagtcaacaaagaaacaatggatttaaattataccttggaacaaatggacttaacagatacatacagaacatttcatccaataaccgcaagatatgcattctattcaacagcacatggaactttctccaagacagaccatatgataggccacaaaatgagcctaaataaatttaagaaaattgaaattatatcaaacactctctcagaccacagtggaataaaactggaaatcaactccaaaaggaacctacaaaaccatgcaaatacatggaaatttaaaaacctgctcctgaatgaacattgggtcaaaaacaaaatcaatatggaaatttaaaaaattcttcaaactgaacaacaataatgatactagctatcaaaatctctgggatacagcaaaggcagtgctaagaggagcgttcatagtcctaaatgcctacatcgaaaagactgaaagagcagaaactgatactctaaggtcacacctcaaggaactagagaaacaaaaacaaaccaaacccaaacttagcagaagaaagaaaataaccaagatcagagcagaacttaatgaaattgaaacaacaacaacaacaacaaaaatataaaaagataaatgaaacaagaagctggttctttgaaaagataaatcaaattgatagactattagcaagattaaccaagaaaagaagggagaaaatccaaataacctcattgagaaatgaaataggagattttacaactgataccactgaaatacaaaagatcattcaaggctactgtgaacgcctttatgcacataaactagaaaacctagaagagatggatgaattcctggaaaaatacaaccctcccagcttaaatcatgaagaattagataccctaaacagaacaataacaagcagtgagattgaaatggtaatcaaaaaattaccaacaagaaaaagttcagaaccagatggattcacagcagaattctactggacattcaaagaagaattggtaccaatccttttgacaccattccacaaggtagagaaaccctccctaattcattctatgaaaccagcatcaccctaataccaaaaccaggaaaggacataatcaaaaaagaaaactacagaccaatacccctgatgaacacagatgttaaaatccttaacaaaatagtaactgatcaaatccaacaacatatcgaaaagataatccaccatgatcaagtgggtttcctaccaaggaggcagggatggtttaacatatgcaagtcaataaatttttgatacaccacataaacagaattaaaaacaaaaatcacatgatcatccctttatgattaaaactctcagcaaaatcggcatacaagggacatacctcagtataataaaagccatctatgacaaacccacagccaacataatactgaatggggaaaagttgaaagcattccctctgagaagtggaacaagacaaggatgctcactcttaccactcctcttcaatgtagtactgaaagtcctaaccagagcaatcagacaagagaaagaaataaagggcatgcaaatcagtaaaggggaagtcaaactgtcactgttagctgatgatatgatcatttaccttgaaaaccctaaagactcctccagaaagctcctagaactgataaaagaattcagcaaagtttctggataaagattaatgtacagaaatcagtagctcttctacacaccaacagtgaccaagtggagaatcaaatcacaaactcaaccccttttacaatagctgcaaaaaaataaaatacttaggaatatacctaaccaaggagtcaaaagacctctacaaggaaaactacaaaacactgctgaaagaaatcatagataacacaaacaaaaggaaacacgtcccatgctcatggatgggcaagaatcaatattgtgaaaatgaccatactgccaaaagcaatctacaaattcaatgcaatccccatcaaaatatcatcatcattcttcacagaattataaagaacaattctaaaattcatatggaactgaaaaagaccccacatagccaaagcaagactaagcaaaaagaacaaatctggaagcatcacactacctgatttcaaactatactataaggccgtagtcaccaaaacagcatggtactggtataaaaataggcacacagaccaacggaacagaatagagaacccagaaataaacccaaatacttacagccaactaatcttcaacaaagcaaacaaaaatataaagtggagaaaggacatccttttcaataaatggtgctgggataattggctagccacctatcacactactgcactccagcctgggcgacagattagagatcttgataaatagagagatgtaccttgttcatgtattttgtaatgttaaggtattaattctccccaaatggatctacagaataagcacaatcccagtcaaaatcccagaagactcttttttttgtataaattgccaagctggttctaaaatacagaaatgaaaagacctagaagaattaaaactattttgaaaaaaaaaagaacaaatttggaggacttactctatgtgctctcaaggtttactataaagctacagtaattaagacagtgtagtttccatataaggatagacatgtatcaatatatagacacagagtccaaaaataagcccacatgtaaaaaagatcagctaatctttgacaaaagtgccaaggtaatcaaatgggagaaaagataatcttttaacaaatgatattggaacaactagttatctatatggaaaacaaaataaaccttaaaccttacttcacacaatagagaaaaactagccttaaataaatcatatatctaattgtaaaagctaaaattataaattttccaggagaaagccttcataatcttgggaaaggcaaagcttttatagacagaacacggaatgcacttaacacaaaagaaaagttgataagttggactttatgaacaaacatttccatacttcaaaagacacaattaaatataagctctagtaaatacaaaaaatataaaaagaactaaaaaacacagttaagaaaatgaaaagacaactacagactgggagaaatattcacaagacatatatctgaccaagaattgtatacaaaatatatgaagacatcaacaatccaataataaggttaaataatttttaaaagtagacaaaaatgttacacattcacaagataagatataggaatagccataaagtgcataaagagatactcaatatcattagtcatcagacaaatgtagactaaagcttcaatgaagcaccgttacatatccactaaaattgctaaaattacaaatatgaccacaccaagtgttggtgagaatgcagagcactgaacattgctggtagaaatgttagatcatacaatcgattattttggaaaagaactctgcagaacttttagagataaaatacaatcactgaaactagaaactcaatggaaagttaaacagaagataatacatgtctgaaaagaaaattagttatccggaagatagatttaaagaaataaccagaatatagcacaaagagatcaatagctaaaaaatatgaaaaatgcatgaagagacagaggttagtgtgagaaagtacaactcagctgcctagacctccagaaggagaagatagagaggataaaggtgatatcaaatagctgaatttcccagaaattgttgaatatatatatcaatctcatatacaaccaacccaactgataacaaggaggataaattaaaacaatgcacacctaggaagatccaaactgcagaacaccaaagaaaaagagaagactatataataaaagcaatcagagagaaaagatgaattacttagttaggaatggcaattatactgatgaattctcagcatcaacaaggtaactcaaaagacagtggaaccatatttttgacgtgctgagataaaatatctgtcaacctacaattatgttcttggtaaaacaatctttcaagagaaggggtaaaataaagaccttttcaggcaaacaaaagctgaacttgactttaggagaatcacatgaaagaaaatttcaaggacaagaataagttaaattattacaaaaggaaggtctgagattcaaggaacggtgagcaaagatactggcaaatatcaggtaaatataaacaaatactgagaataaaacaataagaatgtttatagggtaaaagaaaagtaaaaatactagacagaaatagtgtagaatttggaaggggtgatcaggattatagccttataagaacttgtatctttttattagaaggtaaagttagtaattaattttagactgttaaccatgcattttaagtaactaaagttactgctaaaataatagacatcacaatataacttctaaactaatagagaaggaaaaataaataattcataaagaagaaaagaggctaggcgcggtggctcacacctataatcccagcactttgggaggccgacgcaggcggatcacctgaggtcaggagttcgagaccagactggccaacagggtaaaaccccatctctactaaaaatacaaaaattagctgggtgtggtggtgggcacctgtaatcccagctactcgagaggctgaggcaagagaatcacttgaattcaggaggcagaggctgcagtgagccaagatcgtgccattgcacagcctgggtgacagagcaagactctgtctaaaaaaaaaaaagaagaagaaaaggaaaaaagaaagcacaacaaatagaaaatatacaacaagatgtaataaattaatccaaatataaatagataaaaaaatagttaagtgaaacctgccaattaaaagacaaatattattaaactgaaaaaaaatatgaaatcaagatatttataaaagacttatctaaaacataaggatacagtaattaaaaaaaaaaagggctaagcatagtggctcatgccggtagtcccagtgcttttagaggctgaagcggaaggatgatttgagaccaggattttgagaatagcctgggcaacatagtgagaccctatctctaccacaaaattaaaaataaaaaaattagcgaggcatggtggtacatacctgtagtcccagctgctcaggaggctgaggcgagaaggttgcttgagcccaggagtttgagattatagtgagctatgaccgtgccactgcattccagtctgggcaacaaagcaagactctgtctataaaaaaaatgtattttaatcaaaaaagtgaataaagatatgccaggtaaatgttaaccaaaacaattctgggtaatattagacatatattatacctaatgattaagattctactcattaggaagatacaacatttatacaactaataatatagtttcaaataacatgaagtaaaaaattgacagctacaagagatattaacaaatccacaatcatagttgaagtttttctaacatttgttttagtaattggtagagacagatttttttaagtcagtaataatgttaaaaattagaatagcacaatagacaatcaggatctatgattcgctctctctctctctctcagaatatatattcttttcaagtatacatttacccatttagagaagtgaccacatgctaggctttaagaaaacctcaataaattccagcaggttggcattgttcagaacgtattatttaaccgctagacaattacattggaaatcaatagcaaaaaaggtagaaaatcctcatacctttagagatacaaaacacacttctaaagaatttcacagaagcgagagactctaatggaaactataaaatatttaaaatagaataacaaactagtacatattaaaaatatatgagatataatggtattaagagtgagttttatagcctcaaatgcttaaactggaaaagacgtctcaactgtgtgacctaagcatccaatttatggagcaagaaaaaaaacagctgaataattcccccaaaagtagaagaaacaacaaaataaacataaaagcagaaatgcataaaataaaaaacatagttccaagatagagaatcaacaaagctaaaaatttggccttcgacaatactaataaaatagacaacagcaagattaatgaaacaaaaacagagagacatataaactaattaagaattaatatgcacatatctctagaggctggagagaaaacagattataagatatgaacaaatttgggacaattcgtttgaaaacctagaggagatgaatacatcgtattatgagctgaactgtgttccctccaaatccatatgttaaagtcctaaccacctgtacctaagaatatgcctgtatttggagatagtgtctttaaagaggccattaagtataaatgagatcattagggtgggccataatccaataggattggtgtcataagaggagataaggacacagatacaccgaggaaagactgagtgaagacacggggagaaggtggccaactacaagccaaagagaggggccttgggagaagccaaccctgctgacaccttgatcttggacttccagcctccagaactgtgaggaaacacatttctgttgattcagccatgcagtctgtgtcactttgttatggcagtcctagcaaactaatacacaaacttagaaaaaatctcaatcattagcaaaactaaatctgtaatttaaaagtgttgtgcagccaggagaggtggctcatgcctgtaatcctagcactttgggaggctgaggcaggcggatcatgaggtaaggagttcaagaccagttgggcccaacatagcaaaaccctgtctctagtaaaaatacaaaaattagccaggcatggtggtgggcatctgtaatcccagctactcaggaggctgaggcaggagaatcgcttgaacctggaaggccgaggttacagtgagccgagaccgtgccactgcactccagcctggactagagagcaagattctgtctcgaaaaaaaaaattaaataaataaataaagtcttgtgacacaaaaaaacaacagattcaaatgactagttctagcttgaccaaatatccaagaaacagacaatttcaatttcttccagggaatgaaaaaagagattgtgaggctagcctgacatagatataaaaatcttgaacaaaatataagctgggccgggcgcggtggctcacgcctgtaatcccagcactttgggaggctgagatgggtggatcacgaggtcaggagatcgagaccatcctggctaacacagtgaaaccccgtctctactaaaaatacaaaaaaattatccaggcgtggtggtgggcacctgtagtcccagccactcgggaggctgaggcaggagaatggtgtgaacccgggaggtggagcttgcagtgagcctagatcacaccactgcactccagcctgggcaacagagtgagactcagtctcaaaaaaaaaaaaaaaaaaaaaaaaaaaaaaatatatatatatatatatatatacacacacacacacacacacacacacacatatgctaaccaaatgtagcaatgtctaaagataacactgttgattaacatattgggttgatcctgggaattcaagatcaattaatataactcaccactataatagatctttaaaggagaaaattaaataatgcagaaaagtcattcgataacattcaatgtccattcatgataaaaattcagcaagctgagaatagaaaacaactttttaataaaagacatcttgcttttgtccactttgttagtcttgtgaaaggcccagcctttggctgggttgattctctttattggaactttgttttttattctgtgtgtttctgcttttataactttttctgtaaaagacatcctcaaaaaaaaactctgagaaaacatcataagtaattatgaaatgttgaaaacattctctttaagagcagaaatacaacacgaatatccactgtcaccctttctctttaagattgtttggaaagcttagccatgaagtgagaaaagccaaaaaaaaaaaaaaaaaaagagagagagagaggaagagagacacatagaagaatcggatagaaaggaacaaaattgtcattatttgcgaagtgatacaactgtctacatagaaaattaatctctagaaaaactatcataattagtaaaattgtatagcatgcttgctaaataatatcaattcacaaaaaccaacattgtaatgcacttgtaatgtattgtaatgtaaagataccatttgcaatcataataaaaatataatactcagtacaaaacctaaaaaaggacgtgcaaatccttcaaaggctccattttctctattaaaaattgtttatattaaaggtgcacaacatgacattttgatataaatatacacagtgaaatgattactacgttccatcatctcatataggttccttttttgtggtaagagcaccaaaaaatctatacacataatgaaaggagatcctgacatttgggataacatacatgaacctggaagacattgtgctcattgaaataattcaggcacagaaagacaaatactgcacaatctcatgcataggtggaatctttttaaaaatgtcgaacacatagaaacagagtagaaaggtggttcctgggagtggaaggagggcaaggaaatgagaggggtaggccaaagggttcaaagttacataggatgaataagtccatagatgtaacatacaccatgagaactatagttaataatattgtcttgtatactggaaatttgctaagagggtagattttatgggctgcattttaacaggatttttaggtgatttgtatgcacattatagtttgagaagaactcttttagtgcagtggttttatccttagctgcatattataataaaaactttatacacacacacacacctatacacacacatgttcctggactcccctcattctaatgtgtaataggattggcatcagtgtatcaatacagttcaaaaggctccccaggtgattctcatctaaaccattactcaactggctgatgggagaatgtgcttggagaaaggcacatggaggcttccaagatactagtaatattctattttttcatttgggtgatggatatattggtacactagtctttaaatcatacacatatgttttatacattttgtagtagcttaaatttcagtgtaacacaattaaatacctccttaacagcagtagtgtaatttttattatttagtcatctcattacttccctaatgctggggacacattcctatgttgtctttcttaattatcacagaaatttgggatggcttcaagtcacactacctgatatggtttgactgtgtccccacccaaatctcatcttgagttgtagatgccataatgcccacatgttgtgggaggaactcagtaggaggtaatttaatcacatgggagattaccctcatgctgttctcatgatactgagtgagttctcacaagatctgatggttttataaggagcttttcctccttttgctcggcacttctccttgctgctgccacgtgaagatgggtatgtttgcttccccttccgccatgattgtaagtttcctgaggcctccccagccatgctgaactgtgagtcaattaaacctctttcctttacccagtcttgggtatatccttattagcagtgtgagaatggactaatatactactcatcatataaatttaagcaacaccagaaacaaaacttgaatatgagtctgccattttgaataaataaacccatcatggaattgaaacacctgaatggcacattcaagatttcaccggatcagcttttgccagtaaacgcctggccaagactttggctaattagaaagtgcactttaacactggtggttttttcctttcttgcaaataaaaaactctcatgagcaggttttcccaacagcctctaaaaatttggccaatcttcacatactccaataataagaacaaccataaacaacaatttgaacttggaacttaaggctcaacattcaaattattttatcataacaatggaagaaatcatatttatgtcacaatacttttgaagggaaagtagcctgtgactctgtgcagatgaaatgtaaatgcagagaaatcgcattttctgtacttaattttgattgtagggaaatgggtatcttcatagagtctattacagacacacactggccctgccccacctttgagaggtctccagtgtcttcttttcaaggttgcttttcagacctcataatgttgagagaggtgtcacaaggagaattcccaacccctgagcaaatgggcaaagttgcaagtacccagcagagctgctcaaatattgctgcaaccagaaatccttcataattgagtgggaagcttctagtaaccaggaacaaaaagctgaggaattattacaggtttcttgaaaattattggatttttttttttttttagagatgggggtctcagtcacccatgctggagtgcagtggcacagtcacagttcactgcagcctcagactcctaagctcaagtgatcctcctgcctcagcctcctgagtagctgaggctatgggagctacatgcctggctaacttaaaaaacatttttttttttttttgtagagacaaggccttgctttgttgctcaggctggtctcaaactcctggcttcaagtgatcctcctacctcagcaccccaaagtgctgggattacaggcatgagccaccatgctcagccaaattattggattcctcttcttttttttttttttttttttttgaggcggagtttcactctttttgcccaggctggagtgcagtggcgcgatctcggctcactgcaacctctgccttctggtttcaagcagttctcctgcctcagcctcctgagtagctgggattacaggtacccgccaccacacccagctaatttttttatttttagtagagatgatgtttcaccatgttggtcatgctggtctcgaactcctgacctcgtgatatgcccacctcagcccccaaaatgctggattacaggtatgagccactgtgcctggcctggattctttaaagaagccagaattagaaggagtcatcaatatttgacaacagcattgcattaaagtaacgaatcacagaattataaagccctaagttaacttagagaaaaaactcaaatgtccttagggaagctgtgtctctgagaggctaaaaaactctcttaaagtcagacaagaagtttgtgacaagatcggggtgacacaatagcaaagacttggaaccaacccaaatgtccaacaatgatagactggattaaatgtggcacatatacaccatggaatactatgcagccataaaaaatgatgagttcatgtcctttgtagggacatggatgaagctggaaaccatcattcctagcaaactatcacaaggacaaagaaccaaacactgcatgttctcacttataggtgggaattgaacaatgagaacccttggacacaggaaggggaacatcacacaccggggcctgttgtggggtcgggggaggggggagggatagcattaggagatatacctaatgtgaatgacgagttaatgggtgcagcaccccaacatggcacatgtatacatatgtaacaaacctgcacgttgtgcacatgtaccctagaacttaaagtataataataataataaaaatatatatatatatataaaagaccagggtgagaatccaggtctcctgtctccttgaactaccactattacaaagactcaagaaatcgagtattgattaactgaattaggaattcatagggtttcttgtttggttgcaaatttcattttttacttggagagtggccactctaaattactgatacctactcttttactgtatatggtttaacactgaagactactcacgttatttcactgaaataggttgtctcacaagaaacagtgctcactgggtttctctcacctgctgactggctatccagatagctattttttagagactagatttggcagtcaatgccattgtaaaaagtataatctattttaaatatttaatctacagaatcattttactctcaaaaaatattttaatgtgatgctcaattaaaaagcaacataggtttaaggcacaaaaatgggagtggggagaatatggcagttccttaagaaattaaacatagaattacaatatgatccaactattacgcttctgagtatatacccaaaataactgaaagcagggactcagatacttatacaccattggttcatagcagcattatttacaacagccaaaagatggaaacaacacaaatgtctatccacagatgaatggatagacaaaatgtgatatatataatacatacagtgggatattattcacctttaaaaagtaatgaaagggaagatggcaaagtaagaagcaccaggaatctggctccccatctagacagcaattgccctgacagtatctgtctgatataaccctttggaactctagagtctattgaaggcttgaaacttccaggggaggccttggatggtaaattgatgctaattttggccaatttcagctcttagcaccatagtagctactcatccttcacctccagagctatgacaggcaattgcccatgtcttccaaatatcagggatctgtgctctaatcactgattgctctaaccactgattgctatttctgatcatggagctgcagccaaagaggtgacaggcattgtttttgcactgccctccattgctgcaaacccctcctctggctgaagtgacttccagtggatttaaggagccaacgttctcccccaccccttcattttgcttttcatttttctcttttgggagccagacatcaaagactaggacattcaaatgcaactgcgtatatgggaagctgtagaaaatggctattcatgcccagggaaaggcacaggctcaggagagacctgagaatctcttaagttttacctcaggcttatctttggcatggagacagcttaaaacactttaaaaaacaaaaacagtaacaaaaacccagcaaacatggtcaaggggaaaaactgatttccagaattacaatattatattcaaatatgcagttttcaataaaaaaataacaagacaaataaagaaatgggaaaagtatgacacacacagaggaaagtgacatatcaggagaaactgtccctttaaaagacctgataacagatacactatatgaagacttgaaaacaaccatctcaaagatgttcaaagaactaaaggaagatgttaagaagatcaagaaaaagatgtatgaacaaacttaaaatatcaataaagagatagaaaacctccaaaagaaaccaaaaaatctggagttgaaaagtacaataactgaactgcaaaattcactagaacaagcttgtccaacccacagcctgcaggcctcatgcagcccaggatggctttgaatgcagcctaacacaaatttgtaaactttcttaaaacattatgagatttttaaaaattagttttttagctcatcagctatcactagtattagtgtattttatgtgtggcccaagacaattcttcttccaacgtgacccagggaagccaaaagattggtcacccctgcactagaggaactcaaaggcacatttaattaggcaggaaaaaaaattggtgaatttgaagatagaacagtggaaaatattgagttttagaagcagaaggaaaaaactggagaaaagtaaacagaactgaagtgacctggggaacaccatcgagtgaaccaatatatgcattatgggaatcagagaaggaaaagagagagagaaaggggcagagagaatattcgaagaaataatggcagaaaacttcccaaatttgatgaaagccatgatttaaacatttaagaggcacaatgaactccaagtaacacacattcaaagagacccacaccaaaacatattactgctgacccttgaataacacaagtttgaactgcgtggatccacttatatatattgaattttttcaataaaagttacaccacgtgtgcctgtctcccctttcacttcctccatctcttccacctccaccacccctgagacagcaagaccaactcctccactttctcctcctctcagcctactcagtgtgaagatgacaaggatgaaggcctttatgatgacccaacttaacttaataaatggtaaacttattttctcttccttataattaataacagtttcttttctgtagcttactttgttgtaagaatacaacatataatacacataacctacaaaatatctgttaatcaaccatttatgttattggtaaggtttctgggttactgtaggctattagtagttacgttttgggagagtcaaaagttatgcatggatttttgactgcacaggggattggcacccctaacccctattttgtttaaaagtcagctgtaaatcaaagtcttgaaaagagaatctgaaagcagcaagggagaagtgactcatcaaataaaagggatgctcagtaagattatcaacagatttaacatccgaaattttgaaggccaaaaggcaataggcaaatatattcaaagtactaaaagaaaaaaaattgtccaccaagaatcctatacacaacaaaactgtctttcaaaagagagggagaaattaagatgttctcaagtgaacaagagctgaatgagtttattacctagatcttccctggaagaaatgctaaggaaatcctatgaggtgaaatgaaaggacactatatagtaacttaaaaccataagaagaaataaagatcttaataaggataaatacacaggcaattttaaaagctagtgttattataacaacagtttataattctgctttttattttccacatgatttaagacacaaatacatatattaataaaacaattaatagtgtaagagctggtattattgtaactttgctgtataactccacattttgttttcttcataatttaggaaaataatgcattttttttttttttttgagacagaatctcaccctgtcacccaggctggagtgcagtggcacaatcacggctcactgcaagctccgcctcctgggttcatgccattctcccacctcagcctcccaagtggctgggattacaggcacccaccaccatgcctggctaattttttgtatttttagtagagacggggtttcaccttgttagccaggatggtctcgatctcctgacctcgtgatctgcccgcctcggcctcccaaagtgctgggattacagccatgagacactgtgcccggccaatgcatttaaaataattactagtttatgttttggggcacacaatgtataaagatgtagtttgtggcatcacaattaaataggatgcggacagaaatgttaaaggagtagtttttgtatgttactgaagttaagctgatataaatttaaattagagtgttataactttaggatgtgaaatgtgatccccacggtaaccacaaagaaaatagctatagattatatacaaaaatgagaaaggaatttaaatatttcactacaaaaaaataaacttggctaagcatggtggctcacatctataatcccagcactttgggaggccaaggtggaaggattgcttgagaccaggagtttgagaacagcctgggcaatgcaagaagaacatagctctacaaataatttttttaaagtatccaggcatggtggtgcatgcctgtggtctcagctacttgggaggttgaggtggaaggatcacttgagcccaggagttcgaggctgcagtgaaccaagatcatgccacagcactccaacctggatgacagagcaggaccccatcttaaaacaaacaaacaaacaaacaaacaagtaaacacaaaagaagatagtaatgcaagaaatgagagacaaaaaaactatgagacatattagccaggcatggtggctcacgcctgtaatcccaaaactttgggaggctgaggcagacagatagcttgagcccatgagttgaagatgagtctgggcaacatggcgaaaccttgtctctacaaaaaacacaaaaattagccaggcatggtggtttgcacctgtaatcccagctacttggggggctgaggtgggaggtttgagcctaggagatgaaggttgcagtgagccgagatcacaccactgcactccagcctgggtaatagagtgagaccctatctaaaaaacaaaacaaaacccaaactataaggcatatagaaaacaaataactaaatgacagaagtccctccttatcagtaattaagtgtaactggattaaactctccaattaaaagacagagattggcagaatgaataaaaaatgcataagccaactatatgctctctttaagaaacttacattaaatccaaagacatgaataggttgaaagtaaaagatggaagaaaaaaagatattccatataatcagtaatcaaaaaagagcaggagtgtctatataaatatcagataaaatagactttaaaaaatttgcaagagatagagaaggagattatatattactttaaaccaacaatgatttaaaaagacaaagaagggcattatgtaatggtaaagggttcaattcagaaagaagagttaactatcctaaatatatatgcacccaacacaggagcacctagattcataaaacaagttcttagagacctactaagagacttagataaccacacaataatagttagacacttgaactctctactgacagcgatagacacatcattaaggcagaaaactaacaaaaacattcaggactggaacttgacatttcaccaaatggacaaacagacatctacagaactcttgacctcgaaacaacagaatgtactttcttttcttctgcacatgcacagcagacttagtctttcccccagctagctctgaggaatctgggcagcccagacaagtgctttccttccagtgtagcacaccccctccaccaaggggcagtcagagtgcttcattaaatgggtcctgcatcccatgcccctcaactgggtgagacccccccaacagggtcactagacaccttatacaggagtgttcctgctggcatcaggtcggtgcccttcaaggtcagagatcccagaggaaggagcaggcacatgtctttgctgttctccagcctctttgggtgacatctccaggtgcgggagggacacagaagaatagggcctgaagtgaacccccagcaaactgcagcagccctatagaagagggacctgactattgaaaggaaaacaaacagaaagcaacaacaacagcatcaacaaaaatgtccccacgaaaacctcatccaaaggtcagcagcctcaaagatcaaaactagacaaactcattaagatgagaaagaatcaatgaaaaatgctgaaaactcaaaaggccagaatgcctcttctccaaatgattgcaacacctctccagcaatctctgatttctacggaggatgagatggatgaattgacagaagtaggctttgaaaggtgggtaataacaaacttcactgaggtaaatgagcatgttctaaccccgtgtgaagaagctaagaaccatgataaaagcttacaggagctgataactagaataaccagtttataaaggaacataaatgaccaggtagagctgaaaaccacagcacgagaacctcatgatgcaaaaacaagtattaatagttggatcgatcaagtagaagaaagaacatgagagcctgaagactatcttgctgaaataaggcaggcagacaagattagagaaaaaagaatgaaaaggaacaaataaaacctctgagaactatgggactatgtaaaaagaccaaacctacgactgattggagtacctgaaaaagacagggagaatggaatcaagttggaaaacacacttcaggatatcatccaggagaacttccccaacctagcaagacaggccgaccaaatttaggaaacacagagaaccccagtaagatactccacgagaagatcaaccccaagacacataatcatcagattctccaaggttgaaatgaaggaaaaatggtaagggcagccagagagaaaggccaggtcacctacaaaaggaagcccatcagaccaacagcagacctgtcaccagaagttctacaagccagaagacagtggggaccaatattcaacattcttaaagaaaagaattttcaacccagaatttcatatccagtcaaactaagcttcataagtgaaggagaaataaaatccttttcagacaagcaaatgttgagggaattcatcaccaccaggcctgccttgcaagagctcctgaaggaaagcactaagtatggaaaggaaaaaccagtaccagccattgcaaaaacataacccttaagtgttatgaaataattaggaacccagcccagctctaggattcacccctgagcacaaaggcaatgttgggcatgctggtaaaggaccactagaatccagcagcccagacccctttctttgtggtcaagaaaagcaggaaaagggtgcaggactgctacatcggtgagcataactaatccgataagcagaagtccatgggtggttatgcaccctggaaaggaataagcattaggaccatagaggacgctctaggactaatgctcatgggaaaatgactaagggtgctggcatccctctgttcttttttcagatgggaaacgttccccccaaggcaaaaacgcccctaagatgtattctagagaattgggaccaatttagccctcagatgctaagaaagaaatgacttatattcttctgcagtactgcctggccacgatatcctcttcaagggggagagacctggcctcctgagggaagtatatattataacactatcttacagctagacctcttttgtagaagagaaggcaaatgtagtgaagggacatatgtacaaactttcttttcattaagagacaactcgctattatgtaaaaagtgtgatttatgccctataggaagccctcagagtctacctccctactccagcatccccccgactccttccccaactaataaggaccccccttcaacccaaacggtccaaaaggagatagacaaaggggtaaacaatgaaccaaagagtccctatattccccgattatgccccctccaagcagtgggaggaggagaattcggcccagctggagtgcaggtagctttttctctctcagatttcaagcaaattaaaatagaccaggtaaattctcagataaccctgatggctatattgatgttttacaagggttaagacaattctttgatctgacatgaagagatataatgctactgctagatcagacactaaccccaaatgagagaagtgccaccataactgcagcctgacagtttggcagtctctggtgtctcagtcaggtcaatgataggatgtcaacagaggaaagagaatgattccccacaggccagcaggcagttcccagtgtagaccctcactgggacacagaatcagaacatggtgattggtgccacagacatttgttaatgtgtgtgctagaaggactaaggaaaactagcaagaagcctatgaattattcaatgatgtccactacaacacagagaaagaaagaaaatcctaccgcctttctggagagactaaggtaggcattgaggaagtatacctctctgtcacctgactctattgaaggccaactaatcttaaaggataagtttatcactcagtcagctgcagacattagaaagacacttcaaaagtccaccttaggcccggagcaaaacttaggagccctattgaacttggcaacctcagttttttataataaagatcaggaggagcaggtggaatgggacaaacgggattaaaaaaaaggtcactgctttagtcatggccctcaggcaagcggactttggaggctctggaaaagggaaaagctgggcaaattgaatgcctaatagggcttgcttccagtgcagtctacaaggacacttttacaaagattgtttaaatagaaataagccgcccccttgtccatgccccttatgtcaagggaatcactggaaggcccactgccccaggggatgaaagttctctgagtcagaagccactaaccagatgatccagcagcaggactgagggtgcctgcagcaagcaccagcccatgccatcaccctcacagagccccgggtatgcttgaccattgagggccaggaagttaactgtctgctggacactggtgcagccttctcagtcttactctcctatcccagacaactgtcctccagatctgtcactatccgaggggtcctaggacagccagtcactagatacttctcccagcactaagctgtgactggggaacattactcttttcacatgcttttctaattatgcctgaaaaccccactcccttgttagggagagacattgtagcaaaagcaggtgccattatacacctgaacacaggagaaggaacacccgtttgttgtcccctgcttgaggaaggaattaatcttgaagtctgggcaacagaaggacaatatggatgagcaaagaatgcccatcctgttcaagttaaactaaaggattccacctcctttccctaccaaaggcagtacccccttagacttgaggccaaacagggactcaaaaaaattgttaaggacctaaaagcccaaggcctagtaacaccatgcagtagcccctgcaatactccaactttagcagtacagaaacccaacggacagtggaggttagtgcaagatctcaggattatcaatgaggctgttgtccctctatacccagctgtacctaacccttacattctgctttcccaaataccagaggaagcagagtggtttacagtcctggaccttaaggatgcctttttctgcatccctgtacatcctgactctcaattcttgtttgcctttgaagatccttcaaacccaatgtctcaactcacctggactgttttaccccaagggttcagggatagcctccatctatttggccaggcattagcccaagacttgagccagttctcatacctggacactcttgtccttcagtatatggatgatttacttttagtgacccattcagaaaccttgtgatgtcaagccacacaagcgctcttaactttcctctttacctctggctacaaggttttcaaaccaaaggctcagctctgctcacagcaggttaaatatttagggctaaaattatccaaaggcaccagggccctcagtgaggaacgtatccagcctatactggcttatcttcatcccaaaaccctaaagcaactaagagggttccttggcataacaggcttctgctgaatatggattcccaggtttggtgaaatagccaggccattaaatacactaattaaggaaactcagaaagccaatacccatttagtaagatggacatctgaagcacaatcagctttccaggcactaaagaaagccctaacccaagccccagtgttaagcttgccaacagggcaagacttttctttatatgtcacagaaaaaataggaatagctctaggagtccttacacaggtctgagggacaagcttgcaacccgtggcatatctgagtaaggaaattgatgtagtggcaaagggttggcctcattctttacgggtagtggaggcagtagcagtcttagtatctgaagcagttaaaatgatacagggaagggatcctactgtgtggacatctcatgatgtgaacggcatactcactgctaaaggagacttgtggctgtcagacaaccgtttacttaaatatcaggctctattacttgaagggccagtgctgcaactgcgcacttgtgcaactcttaacccagccacatttcttccagacaatgaagaaaagatagaacataactgtcaacaagtaattgctcaaacctatgctgctctaggggaccttctagaggttcccttgactgatcctgatctcaacttgtatactgatggaagttcctttgtagaaaaaggacttcgaaaagcagggtatgcagtggtcagtgataatggaatacttgaaagtaatcccctcactctaggaactagtgctcagctggcagaactaatagccttcactcaggcaatagaattaggagaaggaaaaagggtaaatatatatacagactctaagtatgcttacctagtcctccatgcccatgtggcaatatggagagaaagggaattcctaacttccgaggaaacacctatcaaacatcaggaagccattaggaaattagtattggctgtacagaaacctaaagaggtggcagtcttacactgcctgggtcatcagaaaggaaagggaaataaaagagaaccaccaagcagatattaaagcaaaaagagccacaaggcaggatgctccattagaaatgcttacagaaggacccctagtatggggtaatcccctctgggaaacaaaaccccaatattcagcagaagaaatagaatggggaacctcacgaggacatagtttcctcccctcaggatggctagccaccgaagagggaaaaatacttttgcctgcagctaaccaatggaaattacttaaaacccttcaccaaacctttcacttaggcattgatagcacccatcagatggccaaattattatttactggatcaggccttttcaaaactatcaagcagatagtcagggcctgtgaattgtgccaatgaagtaatcccctacattacaggccatacattttaatccctgtatctttaacctccttgttaagtttgtctcttccagaatcaaagctgtaaaactaccaatcgttcttcaaatggagccccagatgcagtccatgactaagatctgccgtggacacctggactggcctgctagcccttgctctgatattaatgacattgaaggcacccctcccaaggacatctcaactgcacaacccctactacaccccagttcagcaggaagcagttagagcggtcatcagccaacctccccaacagcacttgggttttcctgttgagagggggtactgagagacaggactagctggatttcctaggctgactaagaatccctaagcctagctgggaaggtgactgcatccacctttaaacacggggcttgcaacttagctcacacccgaccaatcaggtagtaaagagagctcactaaaatgctaattaggcaaaaacaggaggtagagaaatagccaatcatctatcgcctgagagcacagcgggagggacaatgatcgggatataaacccaggcattcgagctgtcaacagctaccctctttgggtcccctctctttgtatgggagctctgttttcactctattaaatcttgcaactgcaaaacacacacacacacacacacacaaacacacactgaagtacaaagatgaatgacaccatgatgaaactgcatcaactagtgtgcaaaataagcaactagcatcatgatgacaggatcaaattcacacataacaatatcaaccttaaatgtaaatgggttaaatgtcccaattaaaagacacagactggcaaattggatagagtcaagacccatcagtgtgctgtattcaagagacctatctcaaatacaaagacacacataggctcaaaataaagggatgcaggaaaatttatcaagcaaatggaaagcagaaaaaagcaggggttgcaattctagtttctgacaaaacagactttaaaccaacaaatatttaaaaagacaaagaaggacattacataatggtaaaggaatcaattcaacaagaagagctcactatcctaaatatatatgcacccaatacaggagcacccagattcataaaacaagtttttagagacctacaaagagacttagactcccacacaataataaggggagactttagactttaacaccccactgtcaatattagttcattgagacagaaaattaacaaggatattcaggacttgaactcagctctggatcaagtggacctgatagatatctacagaactctctaccccaaaacaacagaatgtacattcttcttagtgccacatggggagggagagcatcaggataaatagctaatgcatgcagagcttaacacctaggtgatgggttgataggtgcagcaaaccaccatggcacacatttacctatgtaacaaacctgtatgttctgcacatgcatcccagaacttaaaataaaataaaattaaaaaattttaaaaaagaaggggacagaggaaaaaaatgatcaatgtaatgaaccatattaacagaatgaataacaaaaaacacatgatcatctcaattgatgtagaacatgtatttgacataatttaacacccgttaatgataaacacactctacagacttggaatagagaaaaagtgcctccaaataataaaagctacatatgaaaatccacagtgaacaccatacttatagtgaaagactaaaagctattcctttaaggttagaaacaaagcatagatgtctactttctccacttctattcatcataatactggaagttctactcagagcaatcattcaagaaaaataaataaaaggcatccaagttggaaaagaagaagtaaaattatctttgcagatgatatgattttatatgtagaaaaccctaaagattccacatacaaaaagttgaactaatcaattaattcaacaaagtagcaagacacctttgtgtcttttgcatgttgacttttcaacatgcaaaaatcagttgcatttttatacactgacaacaaacaatctgaaaaggaaattatgaaaagaattatatttacaatagcatcaaaaagaataaaatacttgagaatcaacttcaccaacatggtaaaagatttgtacaatgaaaactacaaaatattgatgaaagaaatttttaaaggcataagtaaatggaaacatatccctttttcatgaattgaaagatttaatattgttaagatagcaacactatccaaagcaatctatagactcaatgcaatctctatcaaaatcccatttttttgtagaaatagaaaaacacatcctaaaattcatatgaaatttcaagggatcccaaactgacaaaacaatcttgaaaaagaagaacaaagctggaggactcacatttcctgatttgaaaacttaatacaaagctacaataatcaaagcagtgtagtattggtataaagacagaaatatggaccaatggaattgaataggaagcccagaaacaaacctgcacatttatgttcaaataattattttacaaaggtgccaagatccctcaatggggaaaagatagtcttttcaacaaatggtgctgggaaaactggacagtcatatgcaaagaatgaagctggagccttacctagcaccatatgcaaaaattaacccaaaatggataaaaacctaaatgtaagccctaaaactattaaaatcttagaagaaaacatagagcaaaagcttcatgacattgaattcggcagtgatatcttggatatgacattaaagacatgtgcaaccaaagaaaaaatacagaaaaattgaacttcataataattttaaatttttatgcataaaaatctatacaagacagtaaaaaaggcaacccacaggatgggagaaattgtttgcaaatcatatatctgataaaggattaatatccaggatataaaagaattcctgaaactcaacaacaatttaaaaaacacaaacaaaccacctcaaaagcaggcaaaaaaaaaaggccaggtgcagtggctcatgcctgtaatcccagcactttgggaggctgaggtgggtggatcacttgaggccaggagttcgagaccagcctggccagcatggtgaaaaccatctctactaaaaatacaaaaactatccgggtgtggtggcacatgcctgtaatcccagctactcaggaggttgaggtgggagaatcccttgaacctgggagggggaggttgcagtgagctgagattgcgccagtgtactccagcctgggtgacagagcaagaccctgtctccacaaaaaaaaaaaaaaaaaaaaaaaaaaaaaaatgcaaaaaacttaaatagacatttcattgaagaagatgtacaaatagccaacaagtacattaaaaaaatgcttagcatctctaatccttagaaaatacaaatcaaaacaactataagataccacctcacacctattaggagggctactatcaaacaaacagaaaataacaagtgttggtgaagatgtggagaaattgaaaccatgtgcattgtcggtgggaatataaaatggtgcagtccttgtaggaaacagtatggcagttcctcaaaaaattaagaatagattaccatatgatccaacaatttctcttctgagtgctgaaagaattgaaagcagagtctcaaagagatatttgcacacccgtgttcataacagccttgttcacaatagctaaaatttggaagcaactcaagtgttcactgatgaatggatgaatgaataatcaaaatgtagtatatacatacaatggaatatcacacagacttacaaaggaaggaaattctgacatacgctacaacacaaatgaatcttgaggacactatgctaaccaaattaagtcaatcataaaaagaaaaatactgtgcgattccaccaataggatgtattaatacttagagctatcaatgtcatagacacaaaagtagaatgggggttgtcaggagctgggggtaggagaagatgtgggaatttaatgggtacggagtttctgttttacaacgtgaaaaagtgatggagatgaatggtggtaatggagatgaatggtggtaatggttgcataacattatgaatatatttaatgccactgaactatacacttaaaaatggtaagatggtaaattttatgcatgtgtattttagcacaatttttaagtgaggggaaaatgaaatctgatatatgctacaacatggatgaaccttgaagacgtgatgctaggtgaaataagccagacacaaaagacaaatgttgtataattcctcttttataaggttcctggaaatagtcaaattcatagaaatagaaaatagaacagtggtcacccagggctgagaggagccaggaatagggagttagcattcaatggctacagagtttaacgggggctaatgacaaagttctggacatggatggtggggatagttgcacaacaatgcaaaggtacttaatgccactgaatggtacaaggaaacatcagtaaaatggtacattttatgttatatatacttcaccacaataaaaaagaaagatttccagctcagatttggagtcggtgcagaggaagacatgttagtgaaagagtacattctcaggaagagctcaattctaaagaaacagcctgtttcactaaacccttaattgtgtggctcctcaaaagctcagaagaagctgatgtcaaaattaaagcacctgttccaccaaagtgctgcggcattgcaaggaaagcacccgttatcttcatctctgtgcctgaacacatcttctcatgtttgttgtcacactttgatgaatgcccccagccagccagctaccctacgtggctgtgtaaactcctcctcttgccctcaaccccaggggtgacctggtgcgttagtgactcctggctgaggtaaacgatacggcacggtggtaatggcaactgtcagatccttcccttttatctccctccatccactgtgaagcgtctctccccagctccctcctaccaggcatcaaaaacccagataaaggggaaaggagttatctgaagtattgtgtgtcccccgtaagaaatccaattatttattgtcactggaaacattttcttttaagtgtgttaatgagtgacctaaacgcatagttttcctcctaccattaacatagctcttcgtctatcccacattttaaaatcttaaacagccctctccctccttcaaaatggagacaaaagttagtggaaacacggtatggccagttacaacacagagaagacacaggatattggagccctgttctttagtttctggtttttgcttaaaaaaaaaaaaaaagaaagaaaaaaacctgcttctaggactaccactgatgtaattttaaaatgagaggtgagcggtgccgttattccagaggatacctttcttaagttctgctctgtgaagggcagggaagtcacacaaaagaattcagttattgcagccacttcctcagtcccctgtatgagtgacaagatagacccctgaggtcacaggagtaaagcctgacatcccactttggtggaggaatctttaggtagacctaatgattagcttcgttttccaaaaagccttcaaccttcccccacccttggtgccaattacaggagagcagttggggaacaacacacatgtcccagaccaatagggtccctgggggatctgtgaattggatagatggaagcgtctttgaatccttgctctagaaagtgtttccacttcaggtgtccccgagctgcttagggaaaggagctactgtgcttttccttgaagcctttttgccattgccgtgtgtgagataaatctaccagtgaagtttctaaggagctggaggacaaaaggtcgggatgaagatctagcaagagattccacttattggctgtggtctgtgccttctctgaacttgcatgttcagaaagaatgagaaagaacccgaggcacctggggctccaggtcatccccccattatggtcccagacccacagcagatgcaacaacccactgaacagccgctcacgtctcctgggcctctcctcttccctttgcccagtgtttctcaaccttgttttcattagcacccctataaccagcctttcttagacacttttgttcctaatcaccccctccatgagatgttaatagcacaggcatgctggatatctgtttatgtactatattggcgctttacagcaagagaaagattcctgcctcttctcaagaaccaatttttgccccactggggacaatatcgcacccattgaaaatgcatgcccgaacacctttggagagccagctggaataggcatgacttgaagacggagctgtggtggggcatcttcccgcggccagtctggcggaatgggaaaaacacactaactctggggtcagaaaggctgtgtcagcatgccagctccacctgcccctagcaggaccagcaggctaaatttaggaaatacccatattcccttaaggctcagtatcctcatctataaaatgggaatcatttctatcttcagattgtagtgagaattcagtaatgaaatctgtattacagcaacaagcatccatcatattgagttctcatctctctctcttccctttagtttctgtcagaaatataatattctggtttacaagagctagtttggattctttagcaagattttacttccctttccagagacatactggattgaaaactaatttgcaaacgaatgtaaaatgtgttgctactatagctggtgtgtaaatgttactatcgagaggtagtaaacctaatcatacatcaaggggaaataaaaagttacgcacatactcaaactttacagctcgctgaaatttctttgcacttgagaaactgagtatattaatcaccctcttctccctactttccttccctaataaaatttcactattctttatttaaggttccatggtaagattagcaacaaaatagaaagcattttctttctttctgaaggtataatagactccctcaggtacatcactcaagagaattatgaagtaagtaagcctctcagatgagattttaaaaggtgactaactttctctggtctgcccaccatctcctttctatatacccgaaagtcagggtttgtttttgaatttagcccattgatggggaaggtgcaagaatgagagtgctttggaaagtttgtgatggaagcagcagggcttggtggcagcctaactggggaagaaaaagagtctaaaattccttcacatgatacgtttcaagagacactaatcttccatcaagtacaaaatgtactttaatgcatactgaaaactaagaaagtcacagttattttaaataagtaaacagacaagattaaatgacattaaatatcaaaagctaatttgagtttctggcatcagagccaatgcttcctccacacatgtgggtagtgggtgatagatattcctgacttggattgtcaccagccttcagagtttgggatgtcatcagtcacccatgggaacagtgaacgatgagtcagagacttccgtggagaaagtgctcttctgggagggagttcactgctatgtccgcttgcatataataggggcacagtaaatgtttattgatatgtggtttttcttgctttagaaaaaagataaacagtctactagtgtgtgtaggcagtgatatgttagggtaacagataaagtctgaaaactcagtgacttagcgccatgaaggttcatttccagcacacacaaagtccatcgcggttccagtgactgcagctgtgtcttccatgtcattgaaccagcttgcttatgaccacgggctttacccattcaacgtgcaacttcagtccagaaatgaggcttatccacttcccctctgcaggggctgagcctgcaggggagcctgggaaatatctgctgagtattctgtctctatcacacatgggtggacttctgcacatctacctttcaataccagatgatgggttcctcttgactgtgcttcctattgatttgggatggatgggaaaggactaactagaattatttattaaagggccagaaagctatttccctcccaaatacatcagcttctgagcaaaaaaaaattcagcacggttggctatagcagtagaaccaccaactagcaaaagcacagctattgtgtagtccacgctatgttagctacaatttgagtgataaattttaagcttaagaggtcaatgaatatcggttgatattaatgaatactcatcagctgacaaagtcagcatcttatttacccatgtcttcttccttcctcaaagtatttctggaataaaatgggatttagtctcccatgactctgttccttctggtaaaagccagtactcaaacccaggagtttatccgaaacgtccagacatctgggaccacaaatagtgaaaaatgggactgtcccaataagcgcagatggctagtaagcttgtggtaccatggactcatttgcaggtatgagatcagtcgtgatggagccaagttattttcttttatgaacttttaatgttttttggcatacttgaaaagtgcaataaaaatgaaaaaatattcatcaatattagtgtatctctgtagtcctactgttgcatggtaatatcattaattatgtatggctcccacagggtagtgtgtttcaagggagtggaaattgaatacaaagtcttttattcttgttttcactccaactcaagtcattagttctctcagcagatctgcccccaaccccaagcccccaatcctaatgcccccatccttgcccactcacagcaactttccggcaagccaaagcgctataccttgaagtgaattcgtggttttcctccaattctcagcaagcgagcattcctattttgagaactggcttaggctaagatagccactcatttctccaagtgccgtcagcacaattgtattttgtgtgtggcatacacatttaccttccgcccttggaacagtgtaattgcttgacattttggctgcctagacacatttgtatctctgaccccccaggtcccatacccagagcagtgacaggctgggacgggtatctgagagaaaacatcttcctcctcccttgtgagccgctcctaacagctgcgctccgttcctgagaccctccttgctttttcatcctccgcagccaagaaactgaattgaatccacttgcagggccatcctctcctgaagatggcagaatctgaacagccaagtgaaagacaggggggcccccacaagcccctgtcctacccacggatcccgaaatagaaggaaatgccctaagctaggaagaaaagcgcaccaagaaaagtgcattctgagccacaccttccatgtggataaagtcaagacttgggtttctggaagcggaaatcttgtcactttccttcatcattcgttttttcttcctcttcctcttcctcctcttcttcctcttcctcctcttcttcctcttcctcttcctcctcttcttcctcttcctcttctcttcctcttctcctccttctcctcctccttctcctcctcctcctcctccttccccccttccccttccccttccccttccccttccccttccccttctccttcttcttcttcttcttttttagagacaaagtctcactctgtcgcccaggctggagtgcagcgtaatcagagctcactgaccgatggagagggaagccagatggggacagaaaagaggtttaggggcgagagggcagacaggtaaatacagagaggtggagactgatggcagaggggaggggcacagggaaggaacagtgccctgcccttctcccgatcacacggggtcgcagcacagtactgccaggaaaaggcccgttccccaggaagtggggatcaccaagggggctgagctcctttgattccttctgagaaatcctccttccctttccgactcccctccaaccataagccacttctcaggcctggccattctcctctctcatcagactagacagagctgggggcatttgaagatgcagacttcacggaacgttaccaacgttccacgttatcacggaaagttaccaacgttccacgttaccacgttaccaacatgcctcctcctctgtgaagcacccccgattgcccctcccatcctccgtctcagtgcactgttttcactcacccgcctctccctccggctcttgagctgaacgagggcagggactgtgtcgtgtttgctgttgtattctcggtaccctctaaggtgcctggggcatggtaggagaccgataaatattggacaaataaattaacaaatgagtggggtgcggtggctcactcctgcaatcccagcactgtgggaggccaaggtaggtggatcatttgaggtcaagggttcgagaccagccgggccaacatggcgaaaccccgtctctactaaaaacacaaaagtcagccgggcgtggtggcgcacacctgtaatcccagttactcggatgctgaggcaggagaatcgcttgaacctgggaggcggaggctgcagtgagccgagatcaggccactgcactccagcctgggaaacagagcgagactacatctcaaaattgaaaaaaaaaaaaattaattaattaacaaatgaatggagcacattattacttctaaaaacgcaatgctgagtgtggcattcttctgcaaaaatagagactggaaccctttgcatgtggtttttccctcaaggaaaaccagggctaaggaaattcagcccttccggacaacaccaaggaaaagcctggccagcacaaaaaaccatttaatttcctttcacaacatctctggtcaccactgttctttatttaatcctataaatccctctttataaatttacttatttatatttaagttaacatggatactcattcactactactgagtttttcaaaactatgtgtctgtctcagcatattttatcgtctgaagcacatgcctggccagctgctagagccgctggaaccggcgtttggatcagtgctggaacacgagtcggggccagagtgattcctgctgcgactgctgacagccagcttgtgaagcactcaggtgctgatagacctggcatataaacaaacctcgacttctgataatatttctaaaagaattaagtgttgttgggtagaccgtagtatatgatgacagaggctagacattctggcagaaccatcttagaaatgaaaatagacatattatcatttaaatttccaaggaaacttatagtactggtatattcaatctgagcgacacgttccctgtggataacgtcgaggcttcggtttctggaaatggaaatctcgttaacttttcttcacctttcagtttctttctttaggaatgaagtctcactctatcatgcaggctgaagtgcagtgtgatcatagctcactgcagcctcgatttcctgggctcaaacaatcctcccgcctcagcctcctgagtagcggggactacaggcacacaccaccacacccagctctttgattccttttagttttgttgaaagtaatcgactcaaattgatcatcttttagagaatacgtgagggatatggtacctaacagaattcttaccagctatcaacacaaagagtggaccaagccaatcagaccaggttaagtctgtaacactgtatgctaagtgaatttcccaaagacctgttgagacgctaggctattccaagtggcagaaaccatcccatctggtgtctgcattctcttgtccttattctgtataacttcactgcagttcctccagtaaaaggcacaaactgcccattgtgggctgcatttggcctacagacattttcctttgctcactcaggagttttgaaagtttccgttaggtgttgacatttaaaaattgggagacctcatttaaaaaaaaatctaggttttattttctctttaaaaatcagaagatgtagcaacactgaatatgaattcttttatggacacattgagctcaaataggagcaacggactctctaataacattgataagaataatagtagtaatagctattcgtataataggatgtactatgtgccacctgctccttaagtgctttgcatatattacatcattttatcctcacatcaaccctatgaggtgggcactataattacctgcagtttctaagtaaggaaaacaagacctggtgaggtcaagtcacttgcctgtagtcacacagctatttatttattcgtttgtttatttatttatttttgagacggagtcttgctctgctgcccaggatggagtgcagtgtcatgatctcagctcactgcaacctccacctttcaggttcaagcaattctcctgcctcagcctcctgggtagctgggattacaggcacatgccaccacgcctagctaatttttgcatttttagtagagacggggtttcaccatgttggacaacctggtctcaaattcctgaccccaggtgatccacccgcctcagcttcccaaagtgctgggattacaggcgtgagccaccgtgcccagccagtcacacagctttaaatgatagaaccaagatttgaaccaagcagtccaaatggttaaatactcataaatgcagtctcccaaatgatgctgggtaggaacaaactattgtaggcacacggatgtctagatgtaaatgctgttgtgactaacatataatagttcaaaagagtatggggtctggagtcagattccctccatttgaatctagtctcagccacatttcacctgggagaacttgggcaacttgattaatatttttaagctttagtttcatccgtaaaatgaggaaatagtaccttccccatggattatttagactttacagaattaagtgaggtaataaaatccttatccttagcataagtaagcagtggcacatagtaaatgctcaattaatggtcactattgttatttttatctaggtaacttttagcactgaaaatttcatatgtgtctgattgagagaagtcttaagctgatgcaaaacatattctccaatttctaacattttgtagtttaaaggaaattatttatagacaaaaataatacggctctttgggaaatagtgctcaagtactatttcgctggagagcacaaacatataaaatgaaacgccgctttaattttagtttcagtctttccttaagtacaggagtccctccttatctgtgagggatatgttccaagacccccagtggatgcctgaaaccgcagacagtggcaaaccctatatacagcaattttttcctatgcctacatacttatgataaagcttagcctataaattaggcagagtcagagattaacaacaataataataaaatgcaccaattataatggtacactgtaacaaaagttatgtgaatctggtcttgctctctgtctcaaaatatcttactgtactgtacccactcttctgatgatgatgtgagatgatgaaatgcctttgtgatgagtgaagtgaggtgaatgtcattggcattgtgacatagtgttaggctactgcggacctgctgatgttatgtcagaagggggatgaggtgctacaggtggtccaggtcactgggccatgacagtgttgatggttgaacgtcaggagccaatgatgttgatagttggggatcctggatagttgaaagattttttgctgaaaacttttggaagaacattgtaatcagaagttgtccctaactcttcaaagctttgctgcagacgttctaatcctttggtgagcatgcaggtgactttaatgctgcattccaactaaggatcacatttcataattttgtctttaaaagtctgtgaaatctgaaacacttcagcaaatgttggtaatgtccacattgctggttctgcttcagtttcttcttcctcttcctcttcctctgtagatgactcaagttctcccaattcctggtttaacacttgtcaatggccttcaatgtgttctcccacttcctgtcaagcaggtcggcaaatcgttctccaccaacttgtctttctgcatgagtgattttcctaacttcttcaatcccagaaagcctttaaaatcattcttgacttcactccacaggttcttgcagcagacatttaccattgctggtttcgattcatgcattgtagctttggtgagtgttattgtgtcaacgatagtgaataatttccagcaccgcattgtgtccagattagagtctgcctcgattgctgatcaaaatctcaggtggatgtatatggttttgacaaaccaaatgacgtcatgccctggacaaagggctgaagcaacaaggttgtaatcagaagtaaaaacacaaccttgacattttaattttcacaacaaacaaattcaacaaaggttgtactccgaagtaaaaacacaaccttgacattttaattttcacaaaaacaaattcaacaaacaaaaaaattgtccaggtgcaatgtctattgtccaaacaggactttaaattccaactcttccacttccatttattttttcacttctgggatgaagcatcggtgaagccattccataaacaagatgattctcacccacactttctgattattttgacagaagatgggcagataatttgggggggtttaaatcatgaatttttttaatttttaatttttgtgggtacatagtaggtggtggttgttgttgttgagagcacatgcgttcttcactttgtgcatgacacctggctttatcgtatgccctgcagcattgccacctggtaccagggttaatctgcccatccgtgcttcatgccccagtgcctcctttgaacttttatgaatagaggttctatcgggcgtcttcttccagaaacacctcgtttcatcacagttgaagatttgctgtggatggtattccttcttcttaatcaacttcctcagctctgccagaaatgcagcagctgcttcttcatcagcaggtgcagcttctccagtaatgtttttattttttcgtccaaacctattcctgaatctgtgtaaccatcccttacttgtagtaaatggcttgatatcacttgtttcaggggaccccttgctcaaggcttcctataagttcagtgctttatggcacaacgcatttgtcgtcaattgaaacacattttccattcatgtcctccacctgcaaatctaggtggttcaacctactacacacctaggtacgtggtataccctacggctcctaggctacaaacctgtatagcatgtgactctactgaacactgtaggcaattgtagcaaaatggcaaggatttatgtatctgaacatatctaaacacagaagaggtacagtaaaaatatggtatcaaagacaaaaatgaaacacctgcatagggcggctccatgataatcttgaccgatgctgatcgaaacatcgttatgtggtgcacccctgtgtttataaaaacctaaaatgggcatactttatgaccaattaatttatcttgtataaattaattttaaaggccggggcggtggctcatgcttgtaatcccagcactttaggaggccgagacaggcggatcacctaaggtcaggagttcaagacaagcctggccaacatggcaaaaccccatctctactaaaaatacaaaaattagccgggcatggtggtgggcacctgtaatctcagttacttgggaggctgaggcaggagaatcacttgaacccaggaggtggaggttgcagcgagctgcgatcgtgccactgcactccagcctgggcgacagaatgaaactccatctcaaaaagaaaaactcaacttaaaatatgatctcattgatgaaaatgagcaaaaagtgataaaccatccaataggaaaaataggcaaaagatatgaaaaatagagccatcgtccctgtgttccaagacctccagtgaatgcctaaaccatgttttctgttcatgtgttccacccacaaatttgatgccttttttccaccttcactgagcgcttaccacacgctgtggccatgactatagcaatctgatgtgcaacagcagaaccagcacacatttctcattccttcttcacaatttcacgatagaagatttgaccttactgtagatcttaagaacctcagcgtacaagttttttccttccttataagttgaaaactttctctttttcacattcacatggcttctctttggcatatccaaattgccagcatcactactcttgcactttggggtcactagaaagtaaaataacggtggcttggatgcgagcattgtgatacccaagacagtcaatctgataatcaagctggctaagggactagcaggcaggtagtgtacacaccacagatatgctagacaaaggaatgatccacctctcaggcgggacagagccaatgttgcaagatttcattatgccactcagagcagcatgcactttcaaaacttatgaattttgtatttctgaaattttccatttaatattttcagaccaaggtttgctgcaggtaactgaaaccatggagagcaaaactgtccataggggtaatccattgcattttcagtaagtatttattgagcatctactatatcgtattcatcattctatctctagtattttagcctagcctatagtaggattcagataaatgtctgcagaacgagtaaagccaaaagtgagaaattgatagaatttggtttgttcttccaaaaggtaagatgccagaaaaaattctgaaaatcagttcacgttagagtaagcaaacaaaaaaaaaagtgtaatcaaagaaattttccttgttaaaatcagaatgcattaatactaatgaaaaggagaatgcagaccccgtctgacatattttatactgtttaaagataaacatttgtgcactgcaagccgcaaatggattgaaactccagtgaggactttataagccatctgctagtctactaatgaggctagtaactatcattgtttacggataggcaccaggggtcatgggtatttgttataatgaaagctgcaatgcatcactgcagaaactaaaagagtctttcttcataagggctaattacaaatataataaaacaacatttaaaaaatctcttgaagtccacagagaaacctaacttggcacaccaagtacaaacagtagtacccgctctgtttgcatttagtggattctgattacagaagccatatcatatttaactactaacaatacaaggccaccgatgggtcctttgcctcagatcacttaatcacaagatgctttgtgaaccatctggatctctgagatatttgctctgacaatctatgcatagagtatgcaaactcacagcaagacccatggggtttttgtgtctgtgtgtgtgtttttaataagatgctaccttaaagttctgcctccctggtgtccacactgaactttgtgagttagttatctcagtgcaggggtggaatgtgaaaaattgattgcttagagtcatagaaacaaaggaactaataggctgactacatttttttactttttattggcaattttagcatcctaaatatgtagtccaatcttaattgttttggccaatagatagtggcagtatctccacagtccagtggagaaataatttggcctgttgcattagtggatgacaaccacatcaattcatgtgttcccagcatctcagactaggaaaacttaagagtcacaatatgaagggcttcttataaaatgttatatcagtaacagtatcaagacctgagatctcccagatgagaaaaggttacctattttattaaaattgcctgttaataggattactaataataagactacaagaagaaaaatgtctcatatttgtagagtgcttctcgcttattccaaagccttgtgcatgaaaaccaaaacccaaaaaccactaatatatgcacatcccctaaagaatagccaataaaaacgtgaaaatagaagagaaattaggtggatctcgcactaccaaataggaaaacatactaagcttaagtaaagtagtgcagtgcaaatgcaagagtagaataagggatcaaaacgtggaacagaaagaaaagagatttgcctgcagggctgacatgaagggcgcccctgaaattgtgctgaaggcatataagaacgtgtgtgtgatcaacgtggcagtggaaataaatggagaaaataaaaatgatttcatgagtactaccgagataatatgttaactttctggagaaggaatgagattcttatattatatgcaaaaataaagtccagagggctgggtgtggtggctcatgcctgtaatctgagcactttgggaggccaagatgggcggatcacctgaggtcagcagtttgagaccagcctggccaacatggtgaaaccccgtctctactaaaaatgtaaaaattagctgggcacggtggtgggaacctgtaatcccagctactcaggaggctgaggcaggagaatcgcttgaacccaggaggcggaggttgcagcaagccaagatcacaccactgcactccagcctgggcaacagagcaagactccgtctcaaaaaaaaaaaaaatccagagaattaaataactaaggatagaaaataaaactatgaaaaataacttttaaaaatgtgagcaaatatttaatttgcaagagaggaagaagaagagaaggcaagaggtggagagcagtgtggctcacaccccctgggtcatccttgtaaggctatcatgcatcccacaggcagcctcagagggaaagctatgaggcaattttgttcatattcgtgtcataaatttaaaatgtaagataaactatgcttttcaagaaatgccattaacatgctaaaaataattatgtgttcagaggttgcacatgagccacaaattgtgctgatcattttggagggagctgctatccggttagtagggtctgctaccttgtggcttatgcgcatccgaatcatttacataatactgcttactttattcaaggtgcctttttatttttacgcacgcattgcattttagcttcatttcacaaaagtggattagtggtgcacatggtttattgaggcataaaggcaataacgaaataataacatacatactacaaccggaataacaccatacacaaacataataaacaagactccagcacaaatgtggaatgggaactcttacatgttgggacaagtgaatctgtgaaggtgacgatttcacacaagcattggaaaagaaaagtgtgaataggatatagcatcatgaatatctgaaaattggatttcgttcgacaagtgatccattcactttttgcccttcatgctttgtctgtattgaattttgtcccataatggcacaaagccatccaaacttttgtatcactttcacacaagctcagtgacctttccagcatccacatgaggtttcctggaataaaagcaaagtatcgcttttcaagtatgaaaccgatcaattgtatcactaaaggcagagaagaggtagtagcagtaagagatatcagtgacatgaacattaagaaacaaacaacaccagccccaaagttaatggccaatattatgcataaagagaaagcggaataatatggcagataaattgaaagagtctttactaccacatcctcttgctagcagatatttctcaccaagactggacagaactgaggaacagggcatgaagctgcttctagcgtacatgttttccttggggataatgttctacggcttttgatcttatttatctctgaaagcacagactctataaacagatattttcttgttttgttaatgatgatcttgtgagctgtagggcacttgtcactgaaaaggctttgggatcagagctgacagagtatctgctatgcatgaacatagaatgtgagtgaaagagaattcaggtggcagggtgcggtggctggtgcctgtcatcccagcactttgggaggccaaggccggaggatcacttgagctcaggagtttcagaccagcccgagcaacatagcaagaccctattaaaaaataatttttttctattaaaaaatttttttaaaatgccaggtgcagtggctcacactataatcccagcactttgggaggctgaggtaggtggattacctgaggtcaggagttagagaccagactgaccaacatggtaaaaccccatctctactaaaaatacaaaaaatagccaggcgtggtggcaggcatctgtaaccccagctactcagaaagctgaggcaggagaatggtttgaacccaggaggcgggaggttgcagtgagccaagattgtgccactgcactccagcctggtgacagagtgagacatcatctaaaaaaaaaaaaaaacatttaaccaggcatgctggtgcatacctactcagaaagtatgctcctacttgggaagctgaggtgggaggatcacttgaacctaggagttcgaagctgaagtgagctgtgatcgcaccaccgtgttccagactgggtgacagagtgagatcctgtctcaatttagaaaaaaaaaaaaagagagagaaagagaaagaatacacctaaatgccaattcatccactgctttaattatggagaacagttggtggacaaaaagatgccttttgatccaaattaggtgttgaaggaaatggtgaaacaggtaaatataatcaaacggccaccactaagtttgcgctgtgtggagaaaaggaggagcatgctcggcttttgaatgctgaggcacaccaggtatttaacggagagacaatcagagaagacttcagtgtctttgggcaatttttatgacatcattaatacccataacaaccgttttatgatttccagtgatttgtggccagtaatttaataggaatatctttgctactatctgccaccttgaaactctcagtcttacagctttgtctgaagcttgttggcttagcatccaacaaagcagtgaatgtagactttagcaaaaaagcttgacatattttcaaggtctaccttctatcttcatatgcagaactaactgacagactatcaaatacttgttgtcattcctgaaagctgaaatttcatagaaataaactagaatgggaggatgatattctgaggcaagacagtgaaagcctaccgcagttcatcccatggaaatgagaactaatgcgctttcctaaagggtattgaaagaatgcccttcctagattaatagctgcataccacagacccaacctgggttcatctgctctgtaaggataccatatccagaacagcagctaaaattagggttaagtttgtgattgtccactgtcatctgccatgatgcacctagattttgcagaggcaagactggtgaattaaatggagttacaagaaggaccgccagctttgaactattaaagtcttcaagggtggcacccatctctgctatctctctgaatgagatatttactatcaaggtcagagggggtaatttcaggaactttcaggtggcctttcctactatggtagttcttattctacagtcaaggaaccaacgtaggattctgtctgccagttgccacatgtggtcaagagcttgtctctgctgggcccagtggctcacacctgtagtcccagcactttgagaggctgaggcatgtggattacttgagctcaggagttcaagaccagcctgggcaacattgtgaaaccccatctctactaaaaatacaaaaaactagccagtcgtggtggtgtgtgcctgtaattccagctatttgggagattgaggtgggaggatcacttgaacccgggaagttggtggtgcagtgagcaacgatcaagtcactgcgctccagcctgggcaacagagtgagagcttgtttcaaaaaaacaaaaagggaacttgtctgtaaaagaataaaaatgaaaaacttacttaggagactgatgtattctgggactaaggaaatgacacccggtgttgtgggtggcaggatgcatagacccaatgagagacaaactttatcaaggactttcttttctttttttatgaaaaaaaaatttattatagacttttaaacataaagaaaatagaaaaataggacagtgaacattcataaatataccaattaggttcattaacattttgccatatatactttacacacacagacacacacacacatatgcacacattttgctaaaccatttgaaaatatcttagagacattttaacacttcactcctaaatacttcagcacgcacatttataaagacattcttctgtaaactacaatacccttatcccagctcataaattagcaataattgtctaatatcatttaaaatctagtccatattcaaatttcttcagtggccctttgcccaggtcttttacagatgacttttaaaaccaggcttcaggctggacgaaatggctcacacctgtaatctcagcactttggtgcgggcagatcacctgaggtcaggagttcgagactagcctggccaacatggtgaaacactatctctactaaaaatacaaaaattggccaggcatagtggcgtgcacccagctacttggctgactgagacaggagaatcacttgaacccaggaggcagaggttgcagtgagccaagatcgcgccactgcactccagcctgaccctgtctcaaaaaacaaacaacaacaacaaaaaagcatgggttccaatcaaagactgcacattgcatttagttgttaagtctcctaagtaacttttatttttatttttttagagacagtgtcttgctctgtcacctaggctgtagggcagtggcgcaatcatagctcactgcaatctggaactcctgggctcaagagatcctcccaccccagccacctgagcagctgggactacaggcattcaccatcatgcctggctaattttttaagaatttttttagagaatgggttctggctatgttgcccaggctggtctcaaattcctggcctcaagtgcttctcccatctcagcctcccaaagacttgagccaccctgcctggccttaagtaactttgagtatagaagagttacccactccacctccttcttcttcttcccgaatgctgatattttgaagaaatgaggccagttatctctacaacattccacattctgaacctatctgatcatttctttaatggtgtcatttaacttgttgttctagcctcagtatcttctgcaaatgggaaattagatctaaaagctcgactaaattccagttgaactcttttgataagaacacatcataggtgcacactacatgacaaatgaaaaagcatgtctggttgtctgactcctggtgatgcaatgtcattagatcctaaggatctcttcattgtaaacgtatgttgtgcccacaaaaccaatcagcaaatctttggtaagatgatactttgacaccatgagaattctggggtggatgtagatcaattttttatttaatagttttggcatcaaaatccctttaatgttgttttacattaacttttcaactatttaacaatccgattttttaaatattgtaaaacatttgttttccacaaaccataaaatgtatgcaaaagtaagattcacttttataatcatagcagaattactccttaattgacatgcgagcacctttcttttttatttttattttgaaactcaccaggcgcggtgcctcatgccagacatggtggctcacacctgtagtctcatcactttgagaggctgaggtgggcagatcacttgaggccaggagttcaagaccagcctgggcaacatgatgaaactctgcctctactaaaaatacaaaaattagccaggcgtggtggcgcatgcctgtaatcccagctacttgggaggctaaggcaggagaattgcttgagcccaggaggcagaggttgcagtgagactagattgcaccacccatctcaaaaaacaaacaaacaaacacataaaaaaaaccctcatatgtattagtcaaggttctccagagggacagaactagtaggatatatgtatatgtatatagatgggttatatacacacacacacacacacacacacacacacacacaccgtttatgttaatattatatatatatatcatatacatatcatgtattgcgtatgtgattgtgtgagtcagttcttcctatgagagagtttatcagggaggattggctcacacaatcacaaggtgaagtcccatgataagctgtcttctagctggggaagagagaagctggtagtggctcagtccgagtctgaaagcctcaaaccagggaagctgattatgcagccctatgcagactgaaagtctgtggccaaagacccaagagcccccagcaagccactatgcaagtcccagagtccaaagaacctggagtctaatgtccaagggcaggagaagtaggaggaagcacccagcacaggagacggagggcagccagaggactcagcaggcaaggttatcccaccccctcccacctgtggcactggcatctgatcggatggtgcccacccacattgagggtgggtcttcctctcccggcccaccgactcaaacgtcagtctcctctagcaacaccctcacagacacacccagaaacaatactttaccagctgtctaggcatccttcagtccaatcaagttcacatctaatattaaccatcacaccatataatagccagtatgatagccagttaggtaccaagagatgatcacacttcccaaagcaaagcatcattaagagactctggacatatgagaggtgggagtggaggaattactgatggtccagagggaaatggaggcagccagcatgacaggaaatggggtgctggtggaggaacattgaattttagacctggctttcctggtctcagtcctgaccctggcatgggggtggcagaaggagaaaagagtttcatggagtagcttttgatttggtgttatttggtttatttccaggagacctggagttctcattttcatccattggaacttgactttcattctctcgagtgttctattctatattattagctacttcagaggttggggaaagtagtagatcaggcagattttgctcttctccatttccatatccagtgtacaccgcaacatgggtttttccgttaaaatcaacctaagtggctcaggctgtggtggctcacgcccgtaatcccagcactttgggaggctgaggcgggagaaccgcttgagcccaggagttcaagaccagcctgggcaatgtagtgagaatctgtctctacgaaaaataaaaattaagtcccagctactcgggaggctgaggcaggaggatcggttgggcccgagaggtggaggctgcagtgagctgtgatggtgccactgcactccaacctgggtgacagagcaagatgctgtctcaaaataataacaataaaaataaaatacaatcaactgaagcaatgatgtagctgggtgaaggcagctgtcttctgacctaatggcagaacatgcgccaccagctttcctgtgtttcaagagagttgcatattctatttttggctcttattcttcttgggttttcttttaggtgtgacatttggttatctgaagtttcacaaatgtcattcttgtgaatggtggcttaaatgaagcatggctttatcataagcttctatcaatgctgtatcattccaaacgtcacaatcatcactctggcctgcactgcccaggaacaacacccagtcctcctatccaggactccatctccacctctaccaccaccaccgctgctgcccatggccatgctgagcctactgccttatttattttctcacacccgcatttctctaacagggaggccacagtgacatttgacttcttagatattgctctattcaagggccttggatataagatctgggtgttcccttctttccaaggtatagcacctacataggtggctgtagtttcttttgggagcactggggaatccatactgcataggctatgctgtatatcctgcatgaatgcatccttcctcatggacccgtatggaccttttctttactcaatgaattgtgggtctgagaactggcttaggtcttgaaattgggcaagaaggcataacttcccgctaggaatggctgactttagcctccttatcatccattctttttttttttaatttttgtgggtacacagtaggtgtatatatttatggggtacatgagatgttttgatacaggcatgcagtgagtactaatcacatcacataaaattgggtctccattccttaatgcatttatcctttgtgttacaaacaatccaattatactttcagttattttaaactgatcattcattcttgatctctctttagagcttaaaactgcactaagatttttaggataccctgtaaacaatgcccttgttgcctgcccacttatctttcccctagaaacaccatgtttctagaaacacctccctggatctcccctgactgtcattccagatttactgtccttattatgccatctagcttctgacgattaagtgctgctggcctctgctactgtgtgatcagttctgtagtgtcatctcttgtcagccccaacctacagaagacagctgccactgagtttctcagtgtgctggtatcctcactgtcatgggtagcaactgcctagggctggtggcacagatggtaaaaagaatttatcaagatagttttaggtaaagaaaggcagatttattggaaaaagtaggaaaatgtatttcaggaaagcaatgggcaagtcagcaagagaggagctgactgcaaggagacaaaagcttgctggagattttataggatggtgcttgtgctgtgtgctgaagagggctttgtgcggtactgataatgccaaggtcgcagtgagctaacttgcatttttctatcagccgagtgtctggtgatagctgggcgcaggaagatggtgagttatttgcacaggatggctctgtgtcctggaccatgaagaaaggcaaacttacagcttatctgtttttttgctttaccctggtcccaaccatcttgactccttttccctaattaggactccaaactcaccagtgcattccttatcacctgcatccatgcagtgttctccccaggagcatggtcaactgacctcccgtgggagaactattctagcatgtccacttctccaagcctcttgattcttttctccacagtcagtgctggtagttctgccatctttacttcatttttttgtaggccaacactttctgcaagtttccaggacttatccaagcggtgtatgagacccacatcctgggacccttgccaggtagctaattctgagtgaaagaggagtgcccccttatagagaaactctctcttatccagttttatattccaaccttttggtccagcaccatggagattcacttccaggcatactcaccagttcttgccagtacacatcagccaggttctgagctgcttgggtgtagaatccctcttctcccttagcaggctctgctttccctgttaggttgtgctgacatctgaccttaattatgaattttgtggctgggagtggaggtagagcagatcctgaggaagacagatgttgtcttataaggcactgtctcactatctggtcttcaagtaagaagggcccactatcttccaattaggccatgtgggccacttctgaagttcaaggattccagagaatattacagtgagagctctcgattgcatctacctattgtccccaacctaagccttggggtctcactccttccctaccaaagctctgagttcatcttcccaccaaaccaacccttcttggttttctttcataacataaaaaagagtcatttactgagagcactgggctaaattttggagcataaagagatatgactagtgccttccttcatgggacaagagtgagttcacattggctcaagccaatgaccgtttcccatctcctttgccacatgactgtgttagggttgggaatttaacccaagtgaagccaagaggacatgaagacttagctgaggctctgggaaatagggtcctgcactctttattgaattcgctgctccaaagacgtgaagcttgcagtgggcttcctctgcagcatcttgaaaccaggatggggaatcccagagattctgggagttgaagtcaggagatgctgccataaacacctggcaggggaaccaagctagaagcagcactgtggagaaaagaatcctgctgacacaattccttctctcggtcaggccatactcaactgcacatctgacttgtgtgaaacggtagcctcccacttttgtttaagtcagtctgagcattttgtcatggtgtccaccctaaagaagttcatagtgcagcaaaaatcagtcacagtttatgataatctgactcatattttatatgattccctcaaaaactgttcagttattgtttccttcagttgggaagctagattgtctgctctgttgagtcccggtcttaggccttctccaccagaatgcatatttatagaggacattcaatatacacttaatgcattgtgtagaaattaaaagaagaccaatcaaatgagaactatgaaaagttgttcattcagagcttgctacaacaagtgaatcacccactattacttgcgttgttgcagagactcaacggaaggcagaggagtgggaaagcttcagagtagaaaaaagagaaggcatcaggtgtgccctgatggagaccatgacctggggaagctgcaggcgggctggctagaggcgagcatcctatgtgattggttaggggggcatacttggtgttggaagcagggacaaaagttagggaagctgtcagttattaatcaaatcttggccatttagggccagttgttacagaagcattttatatatggtctggccatggctcattttgtatattcagtctctctattgagtgaatctcctttccctaatttatatcaaaaatagacttttcaagaatagtttggggattgttgtctttgttgctaaaacttaaaaaaaaaaaaatgtgtctagtactgtcgctgccttcagggctgattcaaatccaatatggatttagagaattaaacccaatctatggtgatattgaagagaagctcaaaatgagaaaaacaactctactcagactaaatacacaataattaatttggatgctgcacttagcaatgaaagacagaacctaaaagggcatttctcaacccctggagtgtgtctcgagcagtgaaaccaaaattagtgatgattaggaatcgaaaaagtcttcctcatcaggcagaagttctagaaattattaacacatttcacatgttaaatgatgataccaagtataaatattatgtaagtacagccacatatccagtgctggggggtatatttttagactgaatttaagaaacataagggctgggcgcggtggctcacgcctgtaatcccagcactttgagagaccgagaagggcggatcacctgaggtcaggagtttgagaccagcctgaccaacatggagaaaccccgtctctagtaaaaatacaaaattagccaggtgtggtggcacatgcctgtaatcccagctacttgggaggctgaggcaggagaattgcttgaatcttgcagtgagccaagactgcaccattgcactccagcctaggtgatagaacgagtctagatagaagaaacttaaaaaagtgcacagcaaatattttttaaaaagaggaataagattctaggataagtttaatatttgcaacaattaccctttaaaaatagaaagctgatcagcaagaaagactctgataaccaatttgatgatgttacagctacattttcacagtatatgttcataaacttaagtactggaattaaaacaaagcagcacatatggtaagactaacaaaatgtaaagtgacagatgtctataaatatgaaaatcatgtatagtatagttcattaattacctgtcattggatcttaaaattaggaatgatatttattcccactcagccatttaatgaatagactttgaatgaggaaaataagatataacaagctggggctttttatatatatatatatatttttttttttattatactttaagttctagggtacatgtgcacaacgtgcaggttacatatgtatacatgtgccatgttggtgtgttgcacccgttaactcgtcatttacattaggtatatctcctaatgctgtccctccccccttcccctaccccaaacaggccccagtgtgtgatgttccccttcctgtgtccaagggttctcattgttcaattcccacctatgagtgagaacatgcggtgtttggttttttgtccttgcgatagtttgctgagaatgatggtttccagcttcttccatgtccctacaaaggacatgaactcaacattttttacggctacatagtataagctggggcttttttaaggtgttactttacttttaacaatcatgcaatcagaagtattgtgttgatttttgtgggggaaagtggggtctcactatgttgcccaggctggtctcaaactcccagcctcaagtggtcctcccacctcagcctctcaaagtactgggattacaggtgtgagtcactgcacccagctttgtgttgatttttactacactgtcatagtgtgaatattgcaaactagagcttaatttaaatttaaatatacagttggccctctgtatctgggggttccgcatccatggattcaaccaaccagggatcaaaaatatgtagaaaaaaaaatggatggttgcatctgtactgaaaatgtacagacttttttcttggccttatttcctaaacaatacagggtaacaactacttacataacgtttacattgcattaggtattataagtaaatggtgtaactagtagaatcaagtatattaaaggaaaattattaatatttgacctgtttgatatcaacattaacatcagagtaaaaaaaatagcaatgttcaactttctttctcctaggaaacattcctaggtggttgaggagggtgacttacgacttcctctcaaagatatctaaaccaagacgtcttcaactttagcctgcatatgcatcacctggaaatcgaggtgtagggtgggccctgagtttgcctttctaaggagagatgctaacaagatctggaccatcagccactcaagacctttaacatgtttcatacctgtcgacaccctgatacaccttggcctctgaaatactttacaagctttgctaaagaacacgttcataatgtaccagttctttagcactgattcccttagggaaatctgttcttcaaggcaagtttcccattgcagttctctatcaacctggcgggggaagttactgccaatcattgaccaagcagcacagattgggagaactccgtaccttggctctataagcaacatcactgttcagagtggtcatccgaagcatgcagactggagatactatgaactctgatcacataaatgaaggattcactgtacttttgtaagcagacagacagggtttccagggattttaggaaatgaataatcaacctgaggaagcagcctgttttacagcctcttgccctgcagcctgtgtggaatgcagtcgccttgctggttggaaccagcaactgacagaccccagcaacttatagatgaaccccagtgaagtttcttcatgccatgctaaagccctcctcccctagaggagctatagctttattatcataacctgtgacccatcatggcatgtagagggggggtctgggccactgggacccccccccccatacacatgccatgatgcacctctcccttctctatcactccatcaaaccctcctgtcactttcccttgggaagatacggctttggagaacacttcccgtgtgtgtcttacttgtgccaagtaacacaatgcctattgatcaaaatctgagttctcctggagagtcgtttgttactcaccaggcaaataagccccagtttttgggaggtaacattatgaaatattctgaagtagtcccatgaaagatttctactttccttttcaaattattgataaataaatgagcttgctttgggctatggagatagttttacatgaataaatcaattcctctgagcaggggcaccagtgtggagatacaggctgacacaccagctctcgcctgtccctgggtgggaggggctgggccggtgcctcccctggattgtttcctgtttaggcattgccagaggcgggatgagaagaaagggctgtggggatctgaggcttggaattccaagattgctcccaactaagctgtggtgcttagatggacacctgcacaccccgttatcctctggctggtcctacatgttcaaggacccttaaggggctctccacaacagactttcatctcttcttccgaattggcctgctctctgttcaattccctcaaggcagggatggatgactggcaaagttatccaagtgttacgtgagagaaagagaactatttcttttgtctgagtcctttgtctatctttttcttttcaagtattccctgtccttcaagagccaggtgaatgccacgtcctcttcagagccttcctggatgtcacagccgaccattgctggggctcagaaaaagctacctgaacatatggcgctctggcctgcagagtactttgaactggaggagattggaaggcttcagcaatggcctcagcactaagatctctctgaccttctcttgcccttgtgtctcgctcctctttctcccctaagcacagggaggggctgtccctgaactttccttgtctccttaaagatagatctaaaaaggaactcagtttctcctccagagacaagattcactgtatcataggagaagagactgggggtccgggccactcacagacatcgccataggctatcgcctgttcgtcttccccaaaaagcacttattctcccctaagcagcctacatgcccgatcccctcttctttatgaagaagtagataagcttgtcaatttcactgggttttgggtactcacttttgtttctcgtgctgctcccatccgtgtaataaatgtgcatgtttttttctcctgttcatctgcctactgtcctggagtcaattatgaaaactcagagagtagagagaaagtgttttctgtccctataggaggcagccgttgctctcatggcactcatcactgtctgcctggcgtcatgcgtaagtacccggttgcccctaaaagattgcaagctctgtgggagcggaaactgtgtctcattcatctcctgcaggcactcaggaaggaggaagaaatggatgaagcctcttatgtcctaaggcctgctaaggtgcttatgtaatcaaattttatcttatccttataatatgtgttgctttacctttgatcactgtaatgccacttatatagcatgttataatttataaagacattttcatatactttctttttaccaacattaatttccaacatccttccatgcgtgtgatattttggggacagtgtagctatctgttcttttgccccaaaattacaaccagcagatggctgcctccatccccacttagagatgttgcctggccgacagctctctgacttcacaaagaggtcatcagtcatcacagaaccacagaatcatgatgtgagggcggctcgcaccccagcgcgcacccaggcaccttagagtccccggctttggctcccctgggtcccctggttgtgcgccaggcaagatgttgagatgcacactggaaaaccggaacgctcaaaccaagcaactgcaagcagctgtctcaaatatggagaagcatttgggagaactgtgccaagtctttgctgcctatgtgcggaaaactgccagactgcgagacaaagtggaccgaggatgaatgaaatcaactcatatgccgctacagaggccccacatctaaggctgggcctgatgaactttgctgatgagtttgccaaacttcaggattattgacaagcagaggttgaaagacttgaagccaaagtagttgaaccctggaaagcttatgtaaccattgtaaaaatgaaacgggatgaccccaaagcaacattcacagcaaggaatcgagaagctaagcaattaactcaggtagaaggaacaggtcagcgaaacccacctcatctgatcgacatgttattgtatcctttgaatttcgacctttaaaaaaaacgttttttaggccaggcatggtggctcacgcctgtaatcccagcactttgggaggctgaggcgggcagatcacgaggtcagaagttcgagaccagtctggccaacatagtgaaatcccatctctactaaaaatacaaaaaaaaaaaaaaaaaaaaattagccaggcgtggtggtgggcgcctgtaatcccagctaatcaggaggctgaggcaggagaatggtgtgaatccagtggtggaggttgcagtgagccaagatcacgccattacactccagcctggctgacagtgcaagactctgtctcaaaaaaaaaaaaatgtttttttaaggttgttactgcccagctcagccagaaaccacatgaggagtggctctttgagagcctgaggggctcattcctgaagggagtccctggagcaggggtttggggctgcgccaattgcttggtccttcttcctttggaccaaaggcagacacagaattacaaagagctgcaatggatgcaacccgaacaagtcatcatctggaggaaactattgacaactttgaaaggcagaaaataaaggctataaagactatattttccaaatttatcacaatcaaaatgttatttcacagcaaagctttagaggtctacacagctgcctaccagaatatacaaaagattgataagcatgaagatttagatttacatgttttcctaaattccctgtatgcaccagattattcatctcgtttagatatggtaagagcaaattcaaagtcacctcaccagagatcatgtcagctaagtgtgtatctggaacaggacaggtatccactaccaactaagaaaggatcagcaagcagatgataatgaggatgaagagtcagatgttacagaagaagacaattttctcaagtaaactacacatttccattttcatcataaatgacatgaaatccacaatgactaaattgtagaactttatactcactttgatatggtaagcctcaaaatgaaattcaactagaaatggaaaaataattaaaggaaacttacgctgaccaaaaatgaaggctttaaaaaatattacacaccagtcatttcaacatccaaaaaaaaaaaaatgacttgagcgtagcaatttgttctctactacaggtgagggaaagaaacccttgaccctgaaaagaagtgttttgcttaatatattatcagaactgggaagagggttgtctcttttctcctcctcctcttcgtttttaaattaacaccccttgtttccaaaaatctattctattagcttcaaattgcctttttgtttcattctacttttcatttagattgccttcttttgttctcatttctttctctatttcttgtaaattttcatctcttctttgctattgtccttttctttgaacccttcatatatttattgtctaaccatgtaaaatgtggtatgaacaatagtcatcttattccctttcacttaattttttggtatcatttattttctgtcctttcatcagtgtctcattttatgaattttctacattatcacttcctccattatttcaattattttttcatttaacatccaggtgatccaaaaacaaacaaacaaacaaaaaaacaagttcagagaattatattacaaacacctgtgggcccactattcggctttatctgaaattttgccaaatttgtttcaggtttttgttttcttgggaaataaaaaataggttaagaaagtcctcttctactcctgttttggtaaaaacaaaatgttatcatgaagtgatgttgaattttatcaagagctatttctgtatttcccatgatgctcccattttttctcaatttgttggtatgacaaaataaacaaaattttctgattttattttattttattttttttattgatcattcttgggtgtttctcgcagagggggatttggcagggtcatacgacaatagtggagggaaggtcagcaggtaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggaggtaaggtcacagatcaacaggatcccaaggcagaagaatttttcttagtacagaacaaactgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacggggtggtggccaggcagaggggctcctcacttcccagtaggggcggccgggcagaggcgcccctcacctccagaatggggtggctggccgggcggggggctgacccccccacctccctcccggacggggcggctgccgggcggagacgctcctcacttcccagacggggtggctgccgggcggaggggctcctcacttctcagacggggcagctgccgggcggaggggctcctcacttctcagacggggcggttgccaggcagagggtctcctcacttctcagacggggcggccgggcagagacgctcctcacctcccagacggggtcgcggccgggcagaggcgctcctcatatcccagacggggtggcggggcagaggcgctccccacatctcagacgatgggcggccaggcagagacgctcctcacttcctagatgggatggcggctgggaagaggcgctcctcacttcctagatgggatggcggccgagcagagacgctcctcactttccagactgggcagccaggcagaggggctcctcacatcccagacgatggggggccaggcagagacgctcctcacttcccagagggggtggcagccaggcagaggctgcaatctcggcactttgggaggccaaggcaggcggctgggaggtggaggttgtagcgagccgagatcacgccactgcactccagcctgggcaccattgagcactgagtgaacaagactccgtctgcaatcccggcacctcgggaggccgaggctggcggatcactcgcggttaggagctggagaccagcctggccaacacagcaaaaccccgtctccaccaaaaaaatacgaaaaccagtcaggtgtggtggcgcgcgcctgcaatcgcaggcactcggcaggctgaggcaggagaatcaggcagggaggttgcagtgagccgagatggcagcagtacagtccagcttcggctgggcatcagagggagaccgtggaaagagagggagagggagaccgtagaaagaaagggagagggagaccgtagaaagagagggagagggagagggagaccgtggggagagggagagggcaaaattttctgattttaaactatctttgcactctgagataaatccaacttgttcatgatatattcttatttatatattgctagaactatgttggccaaaatttatttaggattttgtaactatatccacaaatgaaattggcttataatttatttttgtattgttctgttcaaaattatatgtgttcataagataagttgggaaacattcctctttttctgtttaaaaagttattagattattcagaaaaccatttgttatacatgtaacatttctttgtaagattgcgtttttgatggtttgatttttaactgctgataaaatcatggaagcatgattattgatgtatgcaagttttctgttcaagtctcttttgatatgttacatttattttaggaaaatgtccattttatctttttttttcaattgtcattaagttgtgaacagcattctcgtagggttttcaaaacctctattccctctttgcaatgactcattttagtcctagtgtatttgtgtgtgtgctttatctcattttttctactcaatcttgcttgcaagtcattccattttatttgtttttacagtcaatcagctttaggctttacaatcttctctatcatttcatcaacttatgctttctattaattccttgtatctactattttggggtttactctgttgagtgtttatgtcattacttttcagtcgtttcttttttactaagatacaagcatctgagattatacacctcccacttactacactttttgaaaaatttcaacttttattttagatacaaggggtacatggcaggtttgttacgtgggtagattgcatgatgctgaggtttggggtgtggatcccatcaccacccaggtagtggcatagtatccaatagagagtttttcagtccacttcccctacttccctccccgctctagtagtccacagtgtctgttgttcccacgtttatgtccatgtgtgctcaaagtttagctcctacttacaaatgagagcatgaggtattttgttttctgttcctgcgttaattcgcttaggattatggcctccagctatatccatgttgctgcaaagtatgtggttttgttcttttttatggctatgtacttactacactttcgatgtgttctgcatattatacttctcatgatcattcagttacttattttttttttttgagacagagtctcgctctgtcacccaggctggagtgcagtggcacaatcttggctcactgcaactttcgcctcccaagttcaagcgattctcctgcctcagcctcctgagtagctgggatgacaggtgcacgccaccacgcccggctgatttttgtatttttagtagagatggggtttcaccatgttggtcaggctgatctcaaactcctgacctcatgatcctcccgcctcagcctcccaaagtgctgggattacaggcatgagccacacccctggcctcagttacatattattttctaagtgaagaagcagtttgggattgtgttaaaaaggatgtgttctgcctctgggcagaatcacactgttcctcagtttcattatctgtaaagtggaaataatgacagttcttacttggggtcctatcaggattaaatgagctaaacatgtaaaatgcatggaagaatgtctggcacatcataaaagctcaactactgttggtaattatcattgttataattttttgatttttaagtttttagaaggttttttaatctctagaaatatatcctttgttgcctatttttttattaattttgaattattgtactgaggtaagagaatgcagtcaatatgataaaaaatgttttgctctctactgaaattccagtatcatttttcacagaaataggaaaaaaatcctaaaattcacatggaaccacaaaaaaaaccccaaatagccaaagcaattctgaaaaaaaaaagttggaaacatgaaacttcctgatttaaatttatattacaaagttatagtaaccaacacagtctgatactggcataaaaacagacacatagaccagtggaatcaaatacagagtcccaaaataaatccaaacacagataatcaacgaactttttttttttttttgagacagagtctcgctctgtcgcccaggctggagtgcattggcatgatctcagctaactgcaacctccgcctcctggtgcaagtgattctcatgcttcagcctcccgagtagctgggattacaggtgcccaccaccacatccggctaatttttgtatttttagtagggatgagattttaccatgttggccaagctgatctcaaactcctgacctcaggtgatctgcccacctcagcctcccaaagtgtgggattacgggtgtgagccactgcacccagctggtcaactaatttctgacaagggaatcaaaaaaatacaatgggcaaaggatcatctcttcagtaaatggtgctgggaaaactggatttccacatgcaaaagaataaaattagatccctatcttacacatgcatagaagtcaactcaaaatgaatgaaagacttaaaatataagacctgaaactgtaaaactactagaaaataacataagggaaaggcttcatgacattggtctgggcaaggatttctttggataggaccccaaatgttcaggcaacaaaagcaaagacagacaagattgcatcaaactaaaaagcttctgcacaagaaaacaactagcaaagtgatgagacaacccacagagtgggaaaaaatatttgcaaattatatatgtaatgaaggttagtatccaaaatatataaggaattcaaactactcaatggcatgaaaacaaataacccaattacaaaatggacaaagaacctgaacagacacttctcaaaagaagacataaaagtggtcatcaggttcatgaaaaaaaaaatgctcaacattactaatcatcagggaaatgcaaattaaaactgcaatgagataccactcccacctgttagaatggctcttatcaaaaagaagaaaggtaagtattggtgaggatgtagagaaaagggaacctttgtaacgcattgttggtgggaataaaaattagtactgtcattatggaaaatggtatggagattcctcaaaaatctgaacatagaactgagaggtgacagcgtgccggcagcccttgctcactctcggcgcctcctgcgcctcggggcccactctggccgtgcttgaggagcccttcacccctccactgcactatgggagcccctctctgggctggctgaggtcgcagccgactccctctgcttgcagggaggtgtatggggagacgcccaggcgggaactggggctgcgcccgtgcttgcggaccagtgcgagttcagggtgggtgtgggctctgcaggccccgcactcagagtggccggccggcaccgccggcaccaggcagtgaggagcttagcacccaggccagcagctgcagagggtgcgctgggtcccccagcagtgccggccctgcgctcgaattcttgctgggcctcagctgcctccctgcagggcagggctccagacctgcagcctgccacgtgccagactcccccacgctgtgggctcctgctcagcggagcctccccaacaagcgctgccccctgctccacggtacccggtcccatcgaccacccaagggctgaggagtgcaggcacacggcacgggactggcgggcagctccacctgcagccccagtgcaggatccactaggtgaagccagctgggctcctgagtctagtggggacttggagaacctttatgtctagctaagggattgtagatacaccaatcagcactctgtgtctagctcaaggtttgtaaatacaccaatcagcaccctgtgtctagctcaaggtttgtaaatacaccaatcagcactgtgtctagctcaaggtttgtaaatgcaccaatcagcactctgtgtctagctcaaggtttgtgaatgcaccaatcagcactctgtatctggctaatctgtggggacttggagaacctttatgtctagctaagggattgtaaatacaccaatcagcaccctgtgtctagctcaaggtttgtaaatgcaccaatcagcactctgtgtctagctcaaggtttgtgaatgcaccaatcagcactcggtatctggctaatctgtggggacttggagaacctttatgtctagctaagggattgtaaatacaccaatcagcaccctgtgtctagctcaaggtttgtaaatgcaccaatcagtgctctgtgtctagctaatctagtgtggacttggagaacttgtgtgtctagctcagggatggtaaacacaccaatcagcaccctgtcaaaatggaccaatcagctttctgtaaaaccaaccaatcagctctctgtaaaatggactaatcagcaggatgtgggtggggccagataagggaataaaaggaggctgcatgagccagcagtggcaacccactcgcgtcctcttccacgctgtggaagctttgttcttttgttctttgcaataagttttgctgctgctcagtttttgggtccgcactgactttatgaggtgtaacactcgctgcgaaggtctgcagcttcactcctgaagccaggaagaccacgaacccaccaggaggaatgaacaactctggacgagaggaacgaacaattccagatgcactgtcttaagagctgtaacactcaccatgaaggtctgcagcttcactcctgaagccagcaagaccatgaacccaccagaaggaagaaactccgaacatgtccaaacatcagaaggagcaaactctggacacatcacttttaagaactgtaacactcactgtgagggtccacggcttcattcttgaagtcagtgagatcaagaacccaccaattccagacacagaactaccgtgtcatccagcaatctcatttctgggtgcatatccaaaaaaattgaaatcaatatgtcaaagtaatatctatattcattgcaacattagtcccaatagccaagataaggaatcaactaatgtccatgaacagatgaatggataaagaaaatatagcatatgtatacacaatggaatactaatcaacctttaaaaaataatgaaattcctccatcctggctaacatggtgaaaccctatctctattacaaatataaaaaatttagctgggcgtggtggcaggcacctgtagacccagctgctcgggaggctgaggcaggagaatggtgtgaacccgggaggcggagcttgcagtgagccaagatcgcaccactgcactccaccctgggtgacggagcgagactccatctcaaaacaaaaaaaaaaaagaatgaaattctgtcatttgggacaacatggattaatttagaggacaatatgctaagtggcataagccaggcacagaaaaacaaatattgcatgttctttcttacatgtaggatctaaaaatagttgaactcgtagaagcagagagtagaatggtggttaccagaggctgaatggtttactagaggctgagtgggagagagaatggggtgttgctggtcaaagggtacgaagttttagctagacaggaggaataagttttcagatctactgtacagcagagtgactatagtcaataataatgtatatttcaaaatatctaagagaggaaagttcaattgtattaacacaaaaaatgttgagtgagatgatgtatttgttaactagcttgattcaatcattctacattgtatgcatataccaaagtatcattgtattctataaatataatacaattatgatttatcaaataaagtaatattaattttaaaaagtttttgtattggtatttcctttgtgaccctaacatgttacatgtatgcctaaacattatgtgtgttctctgcttgtgagccatagaagttttctgtttgtttagtttttgggtttttttttggttttttttgagatgaagtttcgcttttgttgcccaggctggagtgcaatggcactatcttctctcagcacaacctctgcctccctggttcaaaggattctccttgcagcctcctaagtagctgggattacaggcccatgccaccaagcctggctaatttttttttaaattttttttttatttttagtagagacagggtttcgccatgttgcccaggctggtctccaactcctgacctcaagtgatcggcccgcctcagctttccaaagtactaggattacaggcgtaagccaccacaccaggcctccatttaactattttttaaatccccaataatactttttgccttcaacaccaagatgcccaatattgttatagcccacaagttttgttccattttttgttttgttttgttttgttttgttttgttttcggatagtagatgtttggttgcccttttttgattgtttacttttgacttttccatatcagtaggtatatctcttataacagaatacagcaagaatctttaaaacacaagttttaactgatactttatctatttatatttgttagaattactgatatattggatttatttctgcaatcttgtttttgtgcttctttccatactttgcttcttatttttcctttctcatcccctagtaaattaaccattttcatcatccctcccttttattttcaactcattttaaagttctatgttctctttattcttttaggaattacccttacattttcttgatgtattttgacttaaaaccaaagttaatcaatatgcttactcatttcccaaacatcattaggatttaaaaacacattttaaaactcccaaaaccttatgtgtcatttttccagtagtttagttacaacattgtttttacaccctcaaattagctattattgagtttgttctttgacatagttagtgctttttagactttgccgaaagtttataaatttccttgctttctatttatttttgtaacttggtctttccttctgagcacagttatcttattcctgaggaggaaaatcaaatggttctgtcagtgagtctgtgaaggcaaatacatggtagtggtgttcccaagccaagaaatgcacataaactggtatccttgagctgggactgtggatttatgctgatctttctcttcgaggttattgcctttcacagttctcagatttatgcagggatctcagttcttaccttccgtcaacagtaggcctaaggccccattccttgcgcctgcatgaaagttaaacccaggtccctgttctccagggacgctcgcctacggctgcttcagaccatgtgctagcagctctggttgtcatttctggatatttctctgggcaatgctttcttgagcactcaggtttacattttagaaaatatttgttctatttttactagcatttgtagttctttaggggagaattttcaaaacattaggtccacagtattgacaagccagaagtcttagatctacagtttattttacaaaaatttcctttctggatttggatcatatttttctgtgacaccgtcatgtataacttttctctctcccaaaaggcttcagtaaattctaaaatacattgtataaatgaaatttttcaaaataactttaataaccacttttacactgagcagaatatgtctctcattctctcaaaaatggtcaggagataattttttcatttatgagtttctattgcagctttcattttcttaggtagacacagtttcagagacaattcaatttcaagtttgttgctgctattataaaatatggactcagtatagacatttagaatactaaatggttcatagaaataaaatgtttctgcactagacaggcaggctgccaatagtttcctagtataagttctggcaaatccctttcccaagaaccttatgaaccaggtaaccctgtgaggaatgcacattacaaactcctgaacacactaaatatataaattgcttttcagaatatctttagcaataagttctttggtgatatgttagtggcagcctcaaaaggtcctaattttatgtgtcagacacacacacacacacacacacacacacacatatttgtttgttttctaaatcgacatatctggaaaaggataatattgggttcatgtctccccttatggccaaagaaaaacagtaatggagaaagaaagaaaaaaaaaaagctcccctgttgatgtgccctgtactgtgattaagataaagaaaagatttttctagatcataaaagtcagcatcttattagtgtccaggaactcaataaaatattagcaaatcaaattcaacaacacatcaaaaagattaaacattatgatcaagtgggattgattgctggcaggcaaggctggtttaacacatgcaaatcaatcaatgagatacatcacattaatagactaaaacatgaaaaccacacaatcagatcaattgacacagaaaaagcatttgacaaagtttaacattccttcttgataaaaaattcttaacagtttaggtatagaaagaaagttcctcaacataagaaataccatttacaaaaacccacagctaacatcataataaggggagaaactgaaaacttttcctctaagacctggtacaaggcagggatgcccattcttaccaccctattcaacatagtactgaaagtcctatcaagagcaattagacaaggaaaagagacaaaatctatctgaattggaaaggaagaagtaaaattatctctatctgcagattacatgattctatatgtagaaaatcccaaagattccaccaaaaactgttaaatataatgaataaattcaataaagttgcaaaatataaaatcagcatggagaaatatgtggcttttctatacacaagtaacaacttagctgaaaaatttaaaaaccatagatcatgatgctcatctaaagaggaaaaagaaagatgaaaggaaagtagttaattaaaatttttttaaagaaatttaaaaaccatcccatttacaatatcataaaaaataggaataaattaacccaggaggcgataaatctgtacaatgagacctatgaaataatgatgaaagaaatggaaaaggacacaaataaatggaaacatattccatgctcatggaccagaagaactgatgttgttaaatgtctatgctacccacagcaacatgtggattcaatgcatcttgaccaaaatcccaacaacattcctcatagaaatagaaaaaacaatcctaaaattcatatagaactgcaaaaaaactcctaatagccaaagccattctgaaaaaaaaaaaaaaatgtggagacatcacacttcctgatttaaatttatattacaaagctatagtaaccaacacagtatggtactggcataaaaacgaacacatagaccagtggaacagaatggagagcccagaaataaatctaaacacatatggccaactaattttcaaaaagggtaccaaaaagacacagtagggaaactataatctcttcaataaatagtgctgggaaaaccgaatttccacattcaagagaatgaaattggactcatctcacaccatacacaaaaaaactcaaaatggataaaagacctaaaggtaaggcatgaaaccataaaactcccagaagtgtgcatagagtaaaagccttggcaatgatttcttgaataccacagtaaaatccaggctacaaaagtaaaaatgaataaagggactatatcaaacaaaaagacttctgcatagcaaaggatacaatcaacaaaataaaaaggcaatttacagattagaaaaaaatatatttgctaactatataacagatgaggggttaaggtccaagatttataaagaacttgtacaacttaatagcaaaaaatcccatataacccgatttataaatttctccaaagatgacataaaagtggacaacagctatatgaaaagcttctcagcaacactaatgattatggagatcaaaaccattatgacatatcacctcacacctgttagaatagccattatcaaaaagacaagaaataacaagtttggggagggtatgaaggaaaaggaacacttgcatgctgttggcgggaatgtagcgttgacccttgaacaacacaagtttgaactgtttggctccacttctatgtgaattttttacagtaaacatattgaaaacatgtttggagatttgtgacagttcaaaaaaacttgcagacaaactgtgtagcctagaaatgtcttaaaaataagaaaaagttaggaatgtcatgaatgcataaagcacgtgtaatagtctattttatcatttactacctttaagtatacacaaatatattataaaaagttaaacggacaaacacagactgtacttggcaccattcatggtcaagagaaatgtaaaccaatgtaaagatgcagtattaaatcataactgcataaaattacctgcagtaatactgtactactgtgataatcttgtagctacctcctattgctgttgtggcagagctcaagtgttgtgaaagtccgcttaaaatgctgtgtgacactgatcatctctaagtgggcagctcatcttgccagtaaattgtgcgttgcagtaaaaagtgatctcttgtggttctcatgtatattttgttgtgtttaatgcaataccataaacctcgaataagaccatgggactcatacgaagtgccactagtaatgctggaagttctcccaaggagcaattaaaaatcatgacattataagaaaaacttgaatttttttgatatgtactgtagattcagctgtggttgccaccatttcaagataaatgaatccagcattcagaccatgtttaaaaaaaaaaaaatgggaaggaaattgtgaagttgtccctacagctacaccagaaggcatgaaaaacttgcactttttatgaactgcctatttgtctcatatagaaaatgcagcttttatgtgggtgcaggattgctataaaattggcatgactataggctctaatataactgggggaaaagcaaagtcattagatgatgagttaaatgacaaggaaggtgaaggatccaaaggtggagaatttggtcgggcatagtggctcacgcctgtaatcccagcagtttgggaggccgaggtgggcagatcacctgaggccaggagttcaagaccagcctggccaacatagtgaaaccccatctctactaaaaacacaccaattaactgggcgtggtggcaggtgcctgtaatcccagctactcaggagcctgaagcaggagaatcgcttgaacccgggaggtggaggttgaagtgagccaagatcacacccttgcactccagcctgggtgacagagtgagactccatctcaaaaaaaataataataaataaaagtggggaattaaatgccagcaaaggatggtttgataattttggagagaggtttagcttttaaaatgtcaacataacaggagaagcagcttgtattgaccaacaggcagcagatgagttcccagatgccattaagataatcactgaggagaagagatacctgaacgaatcagttttcttgttgattttctgttgttgttgttttgagacagagctcactctgtcacccaggctgaagtgcagtggtgatctcagctcactgcagcctctgtctcctgggttcaagtgattctcgtgcctaagcctcccgagtagctggagtcccagctacaggtgcatgacaccacacctggctaatttttgtactttctggcagagacagggtttcaccatgttgggggctggtctggaactcctggcttcaagtgatccgcccgccttagcctcccaaagtgctgagattacaggcatgagacaccacatccgccctgaatcagtttttaatgccgacaaaagtgctctattctgcaagaaaaaaaatgccacaaaggatattcattagtaaggaagagaagcaagcacaggatttaaggcaagaagggataggctaactctattgttttaggcaaatatagttgagtttatgaaaacaggactgcccttatctataaaactgcaaaccccaagccttgaagggaaaagataaacacagctgccagttttttggttatataataagaaggcctggacaagaagaacactttttttggattacttccatcaatgctttgtccccaaagtcaagaagtacctttgcagtaagggattgttttttaaaggtcttttggacaatgctccctggacacccagaacctcatgagttcaacaccaaaggagtcaaagttgtctacttgcccccaaacacagtttctccaattcagtctccagatcagggggtcataagaaccataaggctcattacacactgcaactctacggaaaggattgtcaatgctatggaagagaaccccaaaagagaacatcatgaaagtctggaagggtcacaccattgaagatgccatcattgttagggacggagccatgaaagccatcaagcccacaacaagaaattcctgctgaagaaaactgtgtccagatgttgtgcatgacttcacagaatttacaacagagccaatcaaggaaatcaagacagagattgtggatatgaaaaaaaaaaagctggagagtaaagggttgcaagatatgcatcttggaaaataaaaacaaaatacacacacacaaaaaaaaacacaaaaaatgtgttatggttttttttttttttttttttttttgagatggcgtctcactctgtcacccaggctagagtgcagtggcatgacacgatctcggctcactgcaaccttcgcctcccaggtttaagcaattctcctgcctcagcctccagagctgagattacaggtatgcaccaccatgcccagctaatttttttgtatttttcatagagatggggtttcaccatgttggccaggctggtctcaaactcctgacctcaggtgatccgcccactttggcctctccaaaaaaagttttaagatattgatgtaggagaaattcaagagtgaacagacaccaccctagaggaatcaacagacaacgacgatggagtgagtgcttccaaaccagcgccagacaatgaggcagtgccagaaaacaagttggcattagatgatctggcagaagggttttgattattcaagactgcttttgacttcttttacaacatagacccttccatgatataggcaatgacactaaaacacatgatggaaaaatgattggcatcatatgcaaatatttttagagaaacgaaaaagcaaaaatgtcaggcagaagttacaatgcatttccataaaattacacctactgtgcctgcctctcctgcctcctcttccacctcctccacctcttccgtatctgccaaccctgagacagcaagaccaacccctcctctttcttcctctcagcctactcaatgtgaaaatgagaaggatgaagacctttatggtgaccaacttccacttaaagactagtaaatatattatcttttatgtttaattaacatgaatacataacagttatacatatttatggggtacatgtgatattttaaaacaaacaagcaatgtgtagtaatcaaattagggtaattagaatatccaaaacctcaaatatttatcatttctttgtattagaaacattataattccactgttttagtcattttgagatatacaataaattattattaactatagtcaccctattatgctcccaaatactaggtcttattccttctatctaactgtatttttgtatccattaactattccctttttctgtccacccttcccctcccgaccaactacccttcctagcttctggtaaccatcattctactctctatttccatgagtttactttttcttccaaactcccacagataagtaagaacatgagatatttgtttttctgtgcctcactttttttcacttgacatagtatcctctagctccatccatgttgttgcaaatgacaggatttcattctcttttgtggctgaataatattccattgtgtatataccccacattttctttatccattcatccattagtgggcacttaggtcgactccatgtcttgtctgttgtgaatagtgctgcaataaacctgggagtacacatatctctttgacatactgatctcctttcttttgaatatatacctatcagtgagattgctagatcacatggtcattctatgtttagttttttgaggaacctccatactgttgtccatagtggctatactaatttacattccaaccaacagtgtacaggtgttcccctttctccacatcctctccagcatttattattgcctgtcttttgaataaaagctattttaactggggtgagttaatatcttattgtagttttgatttgcatttctctgatgattagtgatattagacattttttcatatacctgttggccatttgcatgtcttcctttgagaaatgtctagtcagattgattgcccatttttaattggattacttgggattttcttctattgagttgtttcaactttttaaatattctggttaagaatcccttgtcaggctgggtgtggtggctcacgcctgtaatcccagcaatttgggaagccaaggagggtggatcatgaggtcaagagatcgagccaacatggtgaaaccctgtctctactaaaaatacaaaaaattagctgggcgtggtggcacgcacctgtagtcccagctactcaggaggctgaggcaggaggattgcttgaacccgggaggcagaggtggcagtgagctgagatcatgccactgcactccagcctggtgacaaagcaagactctgtctcaaaaaaaaaaaaaaagtgtgttatattcaggatttttgctaaatgggcagattatagttgtacttgtcaccagatggggccaaggatagtgtggggctgaggaatgggtaactatgtgagatgatgaatatgtttattaattttttccatcatagtaactattttactatatatgtattttgtgggtttttattgttgtttttttgagacagaatcccactctgttgcctaggttggagtgcagtcacacaatctcggttcactgcaacctctgcctcctgggttcaagggattctcctgcctcagcctaccaggtagctagaactacaagcgcgcaccaccatgcctggctaatttttgtatttttagtagagatacggtttcaccatgttggccaggctggtctccaactcctggcctcaagggatcctcccaccttggtctcccaaagtgctgggattacaggcgtgagccactgtgcccagcctatatatgtatttttataacatcatgttgtatgccttaagtacacacaataagaaaaaaaaatttagatagaagtttccgggtagctgtgtggaaaaatcaccatagcaaacatgatgggatcccccttcatgtttcccacactcagtaaagcagccctgtgcagacagagctgctcctctgtgcttttcactattgctttgggcgatagaatagctatacatgtagagtttagccattagttataaagccagccggtgtaaccgtgaccagagtgaaggaaagctgtggcagttgtcccagagccactcctgatgcctcctccctcgctccctgcagaagtcaccactcgcctgacttttgtggtagtaatttatttgctctttatctcctccatgtgtgcactctaaacaacagagaatcgctttgtctatttatgaactttttaaggaactttaaataaaaccatgatgtttatattgctttgtgatttgttttctccttggcattggttcatcctggtcgtgagtagcttaattcattcattagggttgctatatagtaatcgctctatgaccataccatgattgattgattgattctcttgttgctctgctatattttatgacaataacctcctccaagtcctctgtatttaccactgtgcctcccatcctctgcacccaaagggtgaacatctagctctttacatactttggacatgatatataacttttgtctttggcactcaagagaatctacagttgtttatacttttcttgaaattcttggaatgccaagagttgcttcattagtaataaataatattcttaaagtcatttttttttaccttcaatcacagcatttatctcagacaaggcccacagtgagcagtcagcaaattcttgtgtatgataatattgatgatgcctggctggtcaccagaaacacttcaaagcagaggttttttgtttttttgtttgtttgtttgtttggtttgttttgtttcttgagaaagagtttcactcacgaagtttcactcttgttgctgaggctggagtgcaatggcgcgatctcagctcaccgcaacctctgcctcccgggttcaagccattctcctgcctcagcctcccgagtagctgggattacaggcatgcgccaccacgcccggctaattttgttatttttagtagagacggggtttctccatgttggtcaggctggtcttgaactcctgacctcaggtgatccgcccaccttggcctcccaaagtgctgggattacaggcatgagccacctcacccagcccaaaccagagttttgagttagacatagttaaagcacatctttcttttccccattgaattgaataatcaagattaaagaaattcacttgttctttttttaaaagtgataaaatatacataacagaaaagttaccatttgaacaatttttaggtatacaatccagtggcattaagtatattcacattttttctgcaacaattactactatccatttccagaactttttcatcatcccaaacaggaactgttctttttaagcactattagttccttttaagcactaattcccattcctccctcccctctagctcctggaaaccactgttctccttcctgtctctatggatttgacaattctaggtacctcatatacaggcagtcgtacaatatcttgccttttgtgactggctcctttcatcacgtgatgattttgactcacgaattaaatgaagtgtcatgaatagttaaaaagtaaaattcaagccccagatccaattcagagaccagccttgcacgtgtattcctttaacttctcccacctcttgccacagtgccaggccgggctcctgtgatgctggtggctggagagctatcaattccagacccaccagggagaatgaacgggaaatcctagagttgtttcactggaaggctgtgaagtggtttccttaaaactgttagttgcttttgccacagtatcgtctgattgaataaccatagagcagtagcatgctttacacttatttatttatttatttatttatttatttatttatttattttgagacagaatcttgctctgtcacccaggctggagtgcagtggtgcgatcttggctcactgcaacctctgcctccagggttcaagcaattctcctgcctcagcctcccaagtagctgggattacaggtgcgcaccaccacgcccaggagtttttgtatttttagtacagatggggtttcaccatattggccaggctggtctcaaactcctgacctcaggtgatctgctcacctcagcctcccaaagtgctgggattacaggcgtgagccactgcgccggtctgcttttcttttttaactgtgaaatacatcaaggacagagaagaatacgtgaaatatatgtgcagctaaaaagagtcataaagtgaacatccacctaacaacccaaatcaagatatagaacttggccagcacccaaaagtcccccgactccctctcccactagagagaataaccattcatcttgacttttacaagaataatttccttgcttttctttgcagttctaccatccatgaatgcaagctttgctcacttttgaattttatgtaagtagaattttattgtatgtattattttgtgacctgcttttttctttttaattatggtaaaatatatacaacaaagtggttaccctctgaaccattttaaaatgtacagtccagttacattaagtgcaatcaccttattatggacttatcaccaccatccagccacagaactctttttgtcttttgcaaaactgaaactttgtgaccattacacaactcccctccacagccccgagcaaccacaattctactttctgtctctgaatttgcctatttctaggtacctcaaattagtggaattaaagtatatgtccttttgtgactggcttatttcacttagcataatgtcctcagagttcatccatgttgtagcatatgtcagaatgtatttcctttttaaagaagaaacatattccattgtatgtatatatatatatatgtgtgtgtgtcacattttcttttctcttttttttttttttttgagacagagtttcactcttgtcgcccaggctggagtgctatggcgtgatctcggctcaccgcaacctccaccttccaggttcaagcgattctcctgcctcagcctcacaagtagctgggattacaggcatgcgccaccacgtcctgctaattttgtatgtttagtagagatggggtttctccatgctggtcaggctgttctcaaactcccgacaggtgatctgcccaccttgcctcccaaagtgctgggattacaggtgtgagccaccacacccggcccacattttattacttttttttttttttttttttgagataggggtctcattctgacgcccaggctggagtgaagtggcacgatctcggctcactgcagcctccacctcctgaattcaagcaatcctccctcctcagccccttgagtagttgggaccacaggtgtgtgccaccatgccgggctaatttttgtagtttttgtacagatggggtttcgccatgctgcccaggctggcctcaaactctgggcctcaagcgatccgcctgcttcagcctaccgaagtgctgggattgcaagggtgagccaccgcaccccgctcacattttctttatccatccatccctcggtgcttggttgcttcctccttttggctattgtgaacaaagctgctatgaaccttggcgtacagatatctctttgaatatctgctttcagttcttttggatatatacccagaagtggaattgttggatcatatgatagttctatttttaattttttgaggaactgccatgttttctacagtagccacgccattttacattcccattaacaggcacaaggatttcaatctctccacatatctgccaacgcttgttattagctgttttttttttttaatagtagccaacctaatggatgtgatgtgtatgtatctcattgtggttttgagttgcattttcttttttctttctttcttttttagagatgaggttttgctatgttgcccaggctggagtgcagtagctattcacaggcacaatcatagtgcactgcagtctcaagctctgggcctcaagggatcctcctgcctcagtctcctgagtagctgggagtacaggctcatggcagcatgcccagctttgatttgcatttccttaatgattagtgatgttgaccatctttttgtgtgcttattggtggtttatatgttttctttggggaaatgtctattcactcatttttaaaactggttgtttgtttgctttttgttgctgtgttttcattctttatatattctggaagtgaaccccttatcagacatatgatttgcaaataattctttcattccataggtggccttttcactttgttaactatgtcctttgatgcacagaagttttaagtgtttggtgtagttcacctagctaatttttgttttgttgtctatgcttttagtgttaatacaaaaagtcattgccaaatccagtgtcatggagcttttctcctatattttcatctaggaattttatagttttaggtcttatacttaagtttcaaattaatttttatatacagtgtaaggtaaggattcatcttcatttttttttttttggcatgacaatatccaattcttccaatactatttgttgaagagactgtcttttccccaggtattggcaccctgttgaaaaacatctgaccatatatgggagggtttatttctggattctctattctattccattggcctacatgtgtgtctttatgccagttaccacactgttttgattatgatagctttgtggtaagttttgaaattaggatgtttgagacctccaactttgttcttctttttcaccattgttttggctatttggaggtccttgagattctatatgaatttgagggctataagaatgtaacctgcttctttttctcaaattaagcttgtgagtttctcccaagttgcacattgtggtagttcatttatttccacagtcatatttatccagtctactcttgttgaacatttggaacctttccactggggctactaagaacagtgctgctatatacatccctacatatattttccggcatggttgtgtaacagtttctctagggtatatccataagagtcgaatttgtatgtttatctgcaactctatagaatattcccctactattttccaaatggttgatacctgtttatggcatataagattccattgctccacctttttatgtattcacctgctatggtttaaatgttccctccaaagctcaccttgaagtttaattgccattgtaacagtgttgggagctagaacctttaagaattgattaggtcacaatggcggggaatggattaatgccattatcatggaagtgggttagttatggtgggagttcagccccctttctctttgcctcgtatgctcacttgcccttcttcccttctgccatcttacgatgcatctggaactccttcaccagacatgaccccttgaacttggactttccagcctccagaaccataagccaagtaaatctcttttctttaaaaattacccaatctgtggtattctgtgatagcagcagaaaacagactaaggcatcaccaaattttgttttttatcacaataaaaaatattagaagcaactcaaatagctatcaatgggcagttagctaaataaattattacagagccatacagcagaatattttacagccattaaaagtgacaagaacagctaacctttattatctaggcaccaggctctgttctaagtgctttccatatatcatctagtttgattcttacaatgactccatgaggtaaatgttactattctgcccatgttacaggtgaagaaactgagacacaaagatattaaactacttcattgggtggggtgcagtggcacatgcctgtaatctcagcactttggggggccgaggggggtggatcacgaagtcaggagtttgagacaagcctggccagcatggtgaaaccccatctctactaaaaatacaaaaaattagccaggcatggtggtgcatgcctgtagtcccagctactcaggaggctgaggcaggaaaattgctcgaacccgggaggcagaggttgcagtgagccaagatcgcaccactgcactccagcctgggcgacagagcgagactccatctcaaaaaaaaaaaaaattacttcctcaacttcacatagctgataaatagaacagtcaggattaaaacccagccaagctgattctgtagctattattaaatggtccaaaataaaatttagaaatgacataaaaataatcaagaaaaccagaactaggcaaatcctgttagtcttaaagctatctaaccttcatatgaaattttgtggatttctttagactggatttcagaaaaagaaatacagaatttttcccatggtcactcttctgaggcacagtcaaaagtgctaggtcattaaaagacctactaaaagttgaaatattgacagaaatatctatattcctcatacatgacacatagccattcaaaatccattttgcttgcagaatactcaaaatgtatttatgtattttcaatcaactccaggatttggtagtttttagaattttaaagagtcagttcctattttagaatatctttctctgcaaatgtccactcctcttgccctatcacctcttcccctcagctgatagcctcgtgtcctgtttcatagagacaggcagtaaccaccgtgtgaagcccaccccaactttctgtcaccgaaaccagaagccacccagatccaaggccaagcccttctccttcccttagagggagtgtccctcctgatagtgtcgtcccatgagccctcaaccccatctctgcaccctgtctcaggaagttcagtgcaccaattatcccctgtactcctcctctcaatttggcctttcccagaatcacataatcatgctctgacagctcccaccttagcaaacaaacaaacaagtaaacacaagcacaagtatccaaacaacaaatcagacatctggtcaagatggtgcaatgaatttatgctttaaagcactcctcttcttaaaactcagtcatgagagataaaatataaaaatagaaaccagactcaaaaagaaaacaaaacaaaaatctctatctctttgcactggaaatagaacagaactgcaaagcaaggccagatgggctccagctccagaggagaacagtatggttgggattgattccggtgtgataaaggggtgaagccaggctcaataacaaggccaggacctgaggtggagcttccctagcatgtgaaaaggggtggaaaaaactgttcctgcacactgtattaaccacatctttcattttctgtattctgatgctttggacatccagggcctggttgaccctggagggactgctcctcccagggtaagccagtttttagagatagtaaacaactcatccacaagcatgtttttcaaataccaacgaaccagtccagagcccaaccacctcctgtattgggctcacatactctgagctagtatccccttgctctaatcaccacaggaccaggtgccaggcaactagggccagtcactgtgtccagagtccactgagatgattcaagccagccatcctaagcctgtttactcggccttgcctgtttgttcctgtggaaactacagtaaagactctgcccagctaagcgcggtggctcacgcctataatcccagcactttgggaggccgaggcaggcagatcacgatgtcaagagatcgagaccaacctggccaacatggtgaaaccccgtctctactaaaaatacaaaaattagccaggcgtggtggcgggtgcctgtaatcccagttactcaggaggctgaggcaggagaattgtttgaacccgggaggcagaggttgcagtaagccgagattgtgccactgcactccagcctggccacagagcgagactccaactcaaaaaaaaaaaaaaaaaaaaaaaaaaaaagactctgcccacagttcccactctcttcctcttcctcctgagcaacttggtttcccttatagccctgcctggcatggtgtgccctttttctcctgggaactgtaagtaacaagctctctttgcaatgtcagtcctctcctgatatgttggccttacaatacctcgaattttctactaatagactatattttaaaacaaacacaacctagggctaaatattttagcaaatagcagacctaaggcatggatggtcacggaaacccttcatgaccaagtattatggcttgagttgtgtcctccaaaaagatgccttgaagtcttaaccccttaacagtcaaagactgttaatggtctttgcagatgtaatgaagttaatatgaagttgttaggataggtcctaatccagtatgactagtgtccttataagaagagaagagaggccaggtgaggtggctcatgctggtaatcccagcattttgggtggccaaggcaggaggattgcttgagcccaggagttccagaccagcttgagcaacataaaaagaccccatctttaccaaaaaaaaaaaaaaaaaaagggaagagacacagacacactgagaaagacagccatgtgaagataaaggcagagattggagagatgctgccataaactaaggaaagcctggggaccccagaggccagtttacagaacactgaaataacggaaggcagttcctagaaaggccaggacagatcctcccctggagcattctgaggaagcgtggccctgcagacaccttaatttcagacttctggcctccagacctgtgagacaataaatttttgttgttttaaaccactcagtttgtggtaatttgttacagtagctcaaaaaaaatgaatgcaccaagcattgaccaagcagaaggattagatgtgcattatggtttgaattgtatctccccaaaattaatacattgaagttctactccccagtacctcagaatgggactgtatttggagatagggcctttaaagagataattaaattaaaatcaggacattaggttgggtcctaatccaatatgactgatgtccttaaaaaagtggaaatcagggccaggcgtggtcattcacacctgtaatcccagcactttgggaggcccaggcaggcagatcacgaggccaagagatcgagaccatcctggccaatatggtgaaaccctgcctctactaaaaatacaaaaattagctgggcgtggtggcgcgtgcctgtagtcccagctactcgggaggctgaggcaggagaatcgcttgaacctgggaggtggaggttgcagtgagccaagatcacaccactgcactccagcctggtgaaagagcaagactccatctcaaaaacatcccccacccagaaaaaaatggaaatcaggtcacagacatgcacagaggaaggcattgtgtagacacaggaaaaagacagcatctacaagccaaggagacctcgagagaaaccaatccctccagcaccttgatcttggacttccagtctccagaattgtacaaaaataagtttctgttgtttaagtaactcagtctgtggtacttcgttaaggtagcctaggaaactaagacaatgtgcaactcaatatcactacaacacaagagccccagaatgccactataagactaaaaacaggctgggcacagtggctcatgcctgtaatcccagcactttgggaggccaaggtgggtggatcacaaggtcaggagtttgacaccagcctggccaagatggtgaaaccccgtctctactaaaaatacaaaaattagccagatgtggttgcaggcacctgtaatcccagctactcaggagggtgaggcaggagaattgcctgaatcagggaggcagaggttgcagtgagccaagatcgcaccattgtactccagcctgggtgacagagtgagacgccaactcaaaaaaaaaaaaagactagaaacacttttgtgttggggattgggggccttgaagccaagtggaaacatctgagtaagatagagaacgatcagttaacaaatgtaaaagatagttgatggccaggtgcagtggctcatgcctgtaatcccagcactttgggaggctgagataggtgattgcttaagcccaagattcaagaccagccttggcaacatgccaagactctgtctttacaaaattaaaaatttttaaaagatagttcagaagctccaacaaacatttccagaagaaaacggaaagaatggcagggaaacaacatttgaatagccaaaaactgcaagtgtgaggtgactgcacattgagagtgaactctgagcaacaagcaagattaggatgaattcccatggagacacattcgatgaaattaaacaacaagaagagaaggagtaagtctcaaaagctatcaaagataaaagacagattatttacaaaagattaatcattaaattggcagcaagaatagatagatgccagaataaaatagtcatatatttaaaggactgaaggaaaataactgtcaaatcacaattttgtgtccagcttaagtttcacacaattatgagggcaaattaaggatattttcagacatgtaccaaaagaaacattgaaagaggtgcttcagcaggaagaaatctgatcccaggagaaaaacgtgagttacaagaaacaaaagtgaacacaaaatttgatagactatgtcagtaaatgtaactgatttgtaaataattaatatatttgagtttttaaaaaatccaacagactgttttctggcaatcagacaaaactgattctaaatccatacggagaaaacaaacacatctgacctttgttgtctggtaatgatgtgctatttccaccaaccttccacccgaaaacaactaaaaatgctaaataaaatatttttaaaatcctcatctgatcatgaggaattaccctgcaaatgttggaggagaaacagaaacccagaatggtatgtggagtatgaaggctacatttgcccaaaggctatctgtggatcctaacaattgtgaattttcattttgaagctgaagaggacaaagggaaaagaaaggaagccctgggtctgaacaaggtggaggctaagaagagagttatattctcaggagagggctcatcctccctgagatgagcagcccaggtttatgttacctgagaaatcccagaggacctgaagccaacaacatggtgtaaggtgctcctgggccagtggtatttccaggtgcctagaagaagcaaatgaacatcttttttgcagaaaaccttcatctcagatcccagggaaaaccccttaactaatagtttaatgatagtgacgaacacacagtcaaagataaccaggaacacaaggaaataaggcaccatgaatgagaacaacagaaataacagacctgttagtctgctgaaaaaagcagacaccacgatggggttaaatgagaaagagatttattacgggaaacacctaatacttctcgaatgcaggaaatgaaggaaaatgggcataagccagagaagatggggagagccatcagactgtgacgcaggtgaaggagaaagggaaggaaggagcgggggatagaagagtcttaccctgcaggtacagttctaaaagagcttgtcaaggccgatgggaaaccctgagccaaaggtgcccatcagaggagttttgtgtttcccagggatagacccagcttagcatccctgccctgcttgggcattagctgggagcagctgaggccgtcggtcagttatactccctgaaactggagacctgagagaagtatctcccagccaccaccccttgtactgtcctgcacttctccatatgggttcagggaggagttcctctttggttattgtgggaatttattcttaacaagcggaaacctaaaagaggagtgtcaggggaatgacgcctctatcactgcagctgatttcagggctgcagctgttacacctctccccagttgggattcgcctcatcttcagcaatgatctcagcagctcttgatggctcacctggtggtgtgaaccaactcttcattcctgagaggtgtgagcccttgatgatcacactctcctaaggctgggcttgttgcatgtgtccattcacaattacagcagggcaagggcgtaccaggatgcaccccagcggatcatgtgggttccattcattctgctccactgcaggagacagggcccctttgtaagttaccactgagcctcctacagttaaccatgaataatgtgttaagggtcccagtttctcattatctctctgcacggcatcaatacaacgtagcagtaactagccactctgctgtcttggtaggcatggcttcctgcccccacctccaaatcttttgaatgcctgcgtctctaccacggccctttcactgggacattttttcacatcattactggtgaaatctctagtaattaagcctcactttgtgccagggactattcacaccccacctaccaaccaggatagcatcgtctttgcccacctggcagtgtgtgaagcaacctcaaatccccatttatcatctgttttcttcaattattccttgtaccctttatgttggtccaggttctacaagaggcagacaccaagacagaattagacatgcaagaatttattaggggaatgcctgtcccggaaagtgggtaggcagccaagggaattgtggaatagtggagagttatattacactgccgttgtggtccctgtgcagcagagagggaacaaggaaggccaggaggaagaatcttgagctgcaatgcagttctaaggaagttcagtaagactgatggtgagtccttgagccaaaacacctatcagaagaatcccacgtctcccagaaacaggctttgggcacagtggctcacacctgtaatcccagcactttgggaggctcaggcaggaagatcacttgaggctaggccttctagaccagcctgggcaacacagcaagccaccatctttacaaaaaaaaaaatcgtgttttaattagctggtatattagtctgttcttgcagtgctataaagaactacctgagactgggtaatttataaagaaaagaagttcgattggctcatggttccacaggctgtacaggaagcatggctggggaggcttcaggagatacacgatcatggtggaaggtgaaggggaaggaggcatgtcccacatggctgcagtgggacaaagaaagtgaagggggaggtgctacacacttttagacaaacagatctcactcactatcacactatcacgagatcatcaaggggaaaatctgcccccatgatgcaatcacctcccaccaggcccttcctccaacactggggattacatttgacatgagatttgagcagggacacaaatccaaaccatatcagctgggcatggtgtcatgcacctgtagttacagctacttgggaggctgagggaggaggttgagactgcagtgatctatgatcacaccactgcattccagcctgggcaaaaataaacaaaaacaaacaaagaaacaaaagaaacaggccttcctcagagtccttgctgtgcccagccacctgtttttacgtattaagaaataaaagactaccttgaaaaatatctctgggagccaggccctgtggttcatgcctgtaatcccagcacttaggaggctgaggggagaggattgcttgaggccagaagtttgagaccagcctgggcaacataatgagactctgtcttcacacacacacacacacacacacacacaaacataaataaaattagccaggtacagtggcatgtgcctatagtccaagctacttgggaagctgaggtgggaggattgcttgagctcaggaggtcgaggatgcagtaaactatgatctcaccactgccttccagcctgggcagcagagcaagaccctatctcaaaaaagaaaaagaaaagaaaagaaaagaaaagaaaatgtctttggggaatcaggaactataaaattaccctaacaaacaaatagaactccaaaaagcaaacaaccctataactaaaattaattactcaaatatagtttaacagcaggctagacagagctaaagagaaaattggtgaactggatgttggtcagaagaaattatgtagaatgtagcacagaggacaaaaaatatagaaaagaggttaaaaaacattgatgataaaataagaaggtctaatatacatttaataagtgtcctaaaaagagaggagaaaaaataactaaaagacaatatttgaaatgataataactaataacttacaagaaagacaaatccacagatttaagaaacttatcaaatcctaagcaggggagaaaatctacaactagatacatgcagtggaactaaaacaaaacaaaacaaacaaaaacatgaaacaatacaattattttaaaggtgcaaagacaaattttcaaagcagccagagggggaaaaaactaattaccttagagggagttaaaacagtcagactgtgtgagacctaattctttaacagccacagtggaaaccggaagacaaagaatgagattttcaatgtgctaagagaaaataattgtcaatttgaaattatttcaggaaggaaacaaagaaagacattttcagacaaagaagacaaagagtttacgaccaggagaagcttgctaaagggaattctaaggggcatattttaaaaaaagaaaaatgatcccatatggagagccagaaatgatgaaggaatgaagaacacaggaagctctaaatgtgttgataaatctaacaaacattgactgtataaaacaaaaataatgatgtctttggggattaaaaaataaatgatagaaatgtaattagtttaatctctatggagggaaatttagcattactgtacttatcaaaattacaaatgtacatatcctttgatttagcaattccacaaagaattgtaggaatttatttgaaggttgagtatttcttattgtaattagtcttcacattgttttgactgcaggcaaggatatttcagatatgtgagcgcttactggaaccaacgaaattcttaagttgtataattcttccaaattctttgataattcctggttcaatctgtgtttacccccactaaatttatgactacttctgtttctaaatgctttacaattgaatcacaattaaatgtaatgagaagatcatatttaaaactccatgattaattattctataaaataacactttttttctattataaagaaaatagcctctaatttatctgtttttcaagtgcagaaaatcgtcatgttgaagtggactgcattgcaaaagcttttaagctgctcgtgtgaactctgaataaattttccctaaaaaccattttattaaaaatgattgtattcacaaataatcttaagaaagttggtttaacccacaatgagttgaaatggtccacacttgtgatgaaaaatagtaaaaagcaacatttgttatttccagaaaattgaaaatggataagaacaagaatcaatctttttgttcaatgtcggtgcctcaggaaaagtgggtaaaagcaatgtagacacacaatcagatgagaagacgacaagagccttctgtagaactctgggccctttttgaggcctttacgagtttatggagaaatcatgaaatgtattattttccttttccttttccttggaaaaaaatatctaagaccataacacgtttgctttaaagttgtgattagtgtcactactgctgcacaaacagaactcgagaaagaagaagagaaatcatcttttttttattattattttttatttttttttgcgagacagagtctggctctgccgccaggctgcagtacagtggtgcgagatctttgctcactgtagcctccaccttccgggttcaagcaattctcctgcctcagcctcctgggtagctgacattacaggcatgcgccaccacgcccagctaatttttgtatttttagtagagatggggtttcaccatgttggccaggctggtctcgatttcttgacctcgtgatccgcccgccttggcctcccaaagtgctgggattacagacgtgagcactgcgcccggcgagaaattatcatttctaaggaagccaaacgggttaagagaggcaaggaggaagaggagggtttaagagaatatgagtgccaacaaagcaactgcatgagactaaataaactgaattataaatggaaaaacacaaaggaaaagtagctagagacaggtctgtcccctgggtaaggatcacaatgcctggccttcgtgaaagctcaatgaagatttattgaacagagcagaactgaactgcccccgagaaaatcgtttgagggtagatgttagttacccatgtggaccaccaggtggcagcatgatctcgtgacccctcaattgtcccaggtaaaacccggatgggaaagaagcccatctaccaccaggagatttttgtggatagatgttcattagtcaaatgttcataatttggtaagaatttgtatgacttttctcaaatcaggtgaaggacggctgaaggaatcttactgatggaatttgggtcccaaactccctacctattttaacctgaagtcattattcttcaaaaattacccaaaaaactacattgctacatttctaaccattaatatcaagttaaaaacacatggaatgtgtgagctagcaataatctagatgaccgacattcagatagaactattgctactacatgttgccttttgctttttatagctgtgaattgacctatttcccaaaaatacaattagtccaagctttattatttcaggcttattcatacatgaatattcctctgagcattactaaaataaaaaccaagtaaaacagattaaaaactatatttaatggtccccaaagaaacccttaaaaaaaatcttctctctgcccatactgaagaatgataccaaaatagtttgaaagtttaaagcaaataattagaaagtaaaacaaaatgttcttaggctatgttgatggagatctggctaaacccttgagaagacaggaaacgtaactgagaaatacgctgttctcctttatctaagtgtgattaactacaatgcttgctctgcaaggtcgggatcacttttcatgaattctttctccgagtgcgtcttgcagggtcaggccctcccctcctgaactccatggttgacaatggatccactggtacagttctgcttctctcctggatgtggaaaaccccaaaattgcactcctcacccagatctcttttccacctacgctcagcactctgtttactgaacatttgcaatggtgaacctgagggtctggaagcccccaggaagaaaagtaaagtgagattccatttcattgccattactgctaagggttattcacgcaagaattccaacaatttacataaggatcattagcctcactggaaatgcatttcattgcaacagacctgagtcttacattcttgacattttccaaggagtggcactgggcattggccatcagaaatggccatggtgattatgcagttttagaaatatgcctaagatacatgagggatgcattcccccaaaccattatcctcagccctacagagtgatctggataagatgtgctgaagctccatggagtttaaagtagtatttattggccggggacagtggcttatgttgaggtgggaggactgcttgagccccggagctcaaggttgcagtgagctatgattgccccattgcccactgcactccagcccggggggacataatgagaacccgtctcaaaaaaaaaaaaaaaagcacttactaaaaaatctgaattcccctttgtttcattcactgtatagggtctactttgaagggaagtgttgtaatctacagaaggcaagggtgacctattaatatttgcagaagataaatgattactctgattactatttgtaggatcaccaatttacactgattctgcactagtctgatacggcagcagtcagtgtaaagtgtactaggtgattttgtggaagccacaatttgtgcaaaatatatcctctcaagctgaaaaggatgtttaaaagatcatggaaatcacgaatgccagtgggagtaatttggggctttatttgttaaattaggcaacaaaatatcagtaagatatttcaagaggaaaatattatttgtaatttaggggaaaaaatccctgaaaaatggagatctgaaacccaaggtagggaaaatcattaggaagaaattgaaaaatattaggcaagagatgaatcctgggtctgtgtagcggggaatggggaaagagtgaaaagtaaaggaaacttcgggaagtgagttatagggcttaggggaaagagggtgataagagaaggaaacaatggttgatttcatagcaggggtcactaaggcaatgataaaggcattaagggagggaggagaagcaggaggaaaaatctggatgaaaagacaatgagcttggtggggggtatattagcaagatatcctcatgatgtctagcaggcatttggaaagtctgtgtggatttcaggggagtaaaactagagctatagatttgggactcctgggcataaaggtggcagttggatctatgaaaatgggccatcagttcatcctcacggggaaatatagaaagaaaaagtgttgaggaagagcctggggaattttacactctggggacagaaagtggcgaaggaagctgtgagatggagatgaggggcatctagagggatgggggaatcagaaaggttcaagggcagagaaccccaggttggagccagttgcaaggacagagcttgtgactggacagcatattcatttgctagggctgccaaagcaaagtaccaagatattagcaccacaggcgggggggcttacagaacagaaatctatcctctcacaactctggaggctaacagtccaagatcaaggtgtcagcagggtcagtttcttctgagggcctctctccttggcttgtaggtgaccatcttctccctatattttcatgtggcctttcttctgtgtgtctgtgtcctgatctcttcttgtaaggacatcaatcatactggattagggcccacccacatgacttcatttgaccttaattacctcttttttttttttcagagtctggctctgttgcccaggctggagtgcagtagcatgatctcagctcactgcaacctccaccccccaggttcaagcaattctcctgtctcaggctcccgagtagccaggattacaggtgcctgccaccatgcccggctaatttttgtgtttttagtagagatgggattttaccatgttggttaggctggtcttgaactcctgacctcaggagatccgcccgcctcagcctaccaaagtgctgggattacaggcatgagccatggcgcctggacagtttgaccttaaaggccctaaattcaaaaacacagtcactttctgaggtactggagagtaggctttcaacatatgaatttgtagggggagacacagttcagcccataccaggctgttagatctggaagttccccactggccaactgagggatacgcattataatggcaacggtgagcctgtcctcagcacatgctacctgctgggttccgtggagagtgcttcacatgtattagcccgtttaacattcacaagcaccctatgaagtaggtactattatcatcagcacgtctttttccagaggaggaaacagaggcaccaagagacactttgcccaaagtcacaaagataataagtggcagaacccacgagctcggcttctacacagtgaatttcatcagcgatttgtagcttgctccaccctcaacagatacctgagaagtaatgatgttgctgaattactcaaaggaacagatgcatttcccatcagctgtcactgactgcagcctctctctaaggtataaggtgaattccgcaggtagatgtgacagcttgaagagaaaggaaaataaacaataactaataggtggttaaagtgtctcagatttaaaaagcaaagagagcaaccctattatgacttcaaatatgtgtgtttatttaagttgtgtttcttacatttggggttgtgattctggaaagtactgtaaaatgcaatgagaaggccaggtgcagtggttcacccctgtaatcccaacactttgggaggccaaggcaggaggatcgcttgagcccaggagcttgagaccagcctgggcaacatagccagaccatgttttgtaaaaatacaaaaattagctaggtgtggtggctcgcacctgtagtcccagctactgtggtggtggaggctggaggatcccttgagcacaggagttcaaggctgcagtgagctgtgatcgtgccactgtactcctgggtgacagagtgaggccctgtctcaaaagaaagaaaaaacaatgcaatgagaaaatatttaacaatgcatttatacactgaaagccttttttgtttgtttttgttttgatttgttttttggagacggagtctctgtcacccaggctggagtgcagtggcactacctcagctcactacaacctctgcctcccagattcaagtgattctcctgccttagcctcctgagcacctgggattacaggcgcacaccaccacacctggctaatttttgtatttttagtagagacggggtttcaccatgttggccaggctggtctcgaactcttgacctcaggtgatccacctgcctcggcctcccaaagtgctgggattacaggcgtgagccaccatgcccggcccactgaaaggttttttgatttgcaatatgtaaaagcatctgttaaattctagattttctatcgttttggctttattggtttttaaccagagatgactttttgaactattttaacttcaggttagcctttaacatgagaaaagtgaggagaaagaaacacacacaggtacacacagagatgcatgcacgcacacacacacacacacaccttcaaacatggatacacggaaatgaagtgagaggaaaagaaataaaaatcaggttactaaaattaaaattcaaacaggaccctctggtgagaattcctgcgagaaggtaggtagcctgtcacttttatctaagagagaagaattcccaggacaatggcacaaaagctgggaaatggctctaaaatgtctctatcttcacttcttaaatccctctccagcgtaactgcatggcgcaggaagccacaaaagcctgaaagaaactgcctgagggtgagtggggctcttccgaaaagactgagtgagggcccccctcttgggctaggccggcgtacccctgcacccgacccctgcagtacctgcagatgggtgttgctgccgccttcgctctcccagctttgaaccactcgtctctgcgtcacttcccgttgggagcatctgattggctgagtccagttcagaagcacattgggagcctctgatttgctgggctaagtcacttactacctgcatcccctttctagtcctctagctggagacattccccgccttccaccaaggctcctgcgccaggcggtacccaaacttaggaaaagggttgagatgttaccggaaaaaggaagttcattacacattttaagcatgtattttcagagacactgaaacatctgaaggcacaagatttctaaattagaaactttaaaagtttccatttatttggtaaggtcaaactacttaaaaacatccttttttttttttttctttttgagacagagtctcgctctgtcgcccaggctggagtgcagtggcacgatgtcggctcactgcaagctccgcctcccgtgttcacgccattctcctgcctcagcctcccgagtagctggaaccacaggcgcccgccaccacgcccaactaacttttttgtatttttagtagagacggggtttcaccatgttagccaggatggtctcgatctcctgaccttgtgatccgcccgcctcggcctcccaaagtgctgggattacaggcgtgagccaccatgcccagcctcttgtcttctttttttgagtctgagtctcactctgtcacccaagctggagtataatgctgcaatctccacccactgcaaccttcgcctcctgggttcaagcagctctcctgcctcagcctcctgagtagctgggattacaggtgcgtgccaccatgcccagctaatttttgtgtttttagtagagacggggtttcaccatgttagccaggctggtctcgaactcctgacctcaggtgatctgcccacctcggcctcccaaagtgctgggattacaggcatgagccaccgcgcccggccaaaagcatactttttttttttggccatgaaaatgcaaatttcatgttggggaaggagataaacagaaagagatggcaaagacagacaagactgttagagggcagaagatggagaagcagcaggagccaggaaagtgaactaattctgactgtcacctgatgtcagacacattgtctcagtgctcactgcgattctgtgaggtgggcgcttttgctcctatgcaacgcataagaagatgggaacgcaaagtaaaatgactgtgagggtcacccactagtaagcagtgcagccaggaatcccgcaagatctgtctgaccccaaagcccaggctttttccctaggctactatagtttcgcctagtgctcctaagaaaagttgtggggcacacatacactagaagaaatacaaccagaagagaaatgagaaaagggaatacaacacacacatttatacatatctccaaatttatgcctggggatattgctgtctccgtgtcattcaaagaaaaagaagtgagaagggagagaattctgtagattctggaataatagttcagctctctagctgcatctttccatgtaccagggttgtgggattcagggttccacccattcctattcttcatagttcaacagctctttatacctgcacgtgaagggtcctggttctggacacttgcagagacattcaggcaggggagttactgattcccaatgaagccagggtagcaaagacattcacaccccaggaacccttaaatggaaacaaaagctcaactaggctgacaggtaggaggctgcatcacccctttgcagctttgtaagaagagtcttccagcttgcaccttggacttttcaaaacagtccaagaatgtcctctgccaaaaggaaaagaccctgttgtatctctaccatatctcttgtcaacactttttttttttattgagcaaccagagcaaaacgctgaagtgaactttgtagctgtttcactaaaaaatcaaacactggccaaattgtttaaaagctaacagtgatcagatggctatgccttttaactgcatgtttgcaaacacacatgtatattgtcttgtgtatactggcctacaaaatcattttagttggacaatctttctacggttcagtatgaatcaatattagtgctgtggtacatttgtgtgccttcattgagttgaacagaaatccaccaagaggtttggttaatatgtggctctagtgtgtatgtctcagtcaagaacatctgaatgtgtgacttctctaggcatcgagcccaaattaattgtggtgctcactctctcatatttattttaagtgtttataaattattattctgctattcataatatagactttaatgggtctgtatataagaatgaaaaagcatacagctatgcaaatcataatcacaatgggagaaaaatggtcttttcatgcctgttaaaatttaagagccaaaacaggagaattttctggcctttatggctggtcagagtccatctgtttcatctgctatttggctgtctgaacggttggattttatttcctctacatcatactgaacttttaagaacaaacaaaagacttttatctgaggatagtacacagatgtgttgtgttacatacttaaataggcatttatatgcacctcgtttttatatctgaaataattcggtgaatgtttcttttttatcttttttagcatttaatccatgactctcaccagttcaactaacatactacaaaatgtcttacgcaaaacagccactcaagaatgttggatgtttaaaagacattgttagtccaaataaactaggaaagcaagcaaaattatttagaatcagtactagtaaaagatttttatgtgtgttaaaatttttttcattactcttatttgtaccaaaaagtgtaatttcatgaggtttgattatataatacaataaaagttattattactaagtatactctatttcagaatagtctatatgacatatatttcttagcattcatagattactagccgctgttgcataaattgaattttttttttttgagacggagtctcgctctgttgcccaggctggagtatagtggcgcgatcttgactcactgcaacctctgccttctgggttcacaccattctcctgcctcagcctcccaaggagctaggactataggcgcccagcaccactcctggctaattttttgtatttttagtagagacggggtttcattgtgttagccaggatggtctcaatctcttgaccttgtgatcagcccgtctcggcctcccaaagtgctgggattacaagtgtgagccaccacacgcctggccacataaattgaattaaatcaaattcctattaagttggaatcatagatctggaagaaatctcaagacagcaaatgatgcagcctcctcccctagtagtagaccaacttacctgctataaaaaataatgattgcctttgcacatttcaagatattgccagggccaggtgaggtgactcacacctgtaattacagagctttgggaggctgaggtgggagatcatttgaggtcaggaatttgaggcaacggtaagctatgatcgtgccactgcactccagtctaagggacagagtgagagcctgtctcaacaacaacaacaaaacaaaaacaaaaaacaacaatatctttagaaaggggtatttcacatcatttgatttcttgttccagtacgatatttgatcttacagaaaagcagttgttgctggctgggcacagtggctcactcctgtaatcccagcacttggcccaggagtttgagaccagcctaagcaacatagggagaccccgtctctacaaaaaaactcaaaaattagctgggtgtggtggcacatgcctgtaggcctagctactcaagaggctgaggtggaaggatcgcttgagcccaggaggttgagagttgaggctgcagtcacctgagatcacaccactgcactttagcctgagcaccagagcaagaccctgtctcaaaaaaaaaaaaaaaaaaaaagccgctcacagtggctcacacctgtaatcccaacactttgggaggcaggtggccaaaatggtgaaaccctgtatctactaaaaatacaaaaattagcccagcatggtggtgcacgcatgtaatcccagctactctggaggctgaggcaggagaattgcttgaacctgggaggcggaggttgcagtgagccgagattgtgccactgcactccagcctgggtgacagagcgagagtctgtctcaaaaaaaaaaaaaagcatttgtcttagctctatctaagctatttttctgtttttaattctttactttggaatattctggacttacagaaaagttgtaggatgaaccattcacatgcatactttctccagtcttccctaatgctaaaatcttacaaatctatggtacatttgtcaaagtaagaaattaacactagcacattactgtttactaaattccacactgtatttggatttcatcaatatcttgttctgttttagcatccaatccaaaaagcatttagtcatcatatctccttagtctgctctgttctgtgaccgtttttcagtctttccttgtcttccatgacttgttttatagaatgttcctcactctgggtttgtctaatgttttctgaggattaggctggagttagggacttcaggggaagcctatatcaggatgaaatgcccttctcatcacatcataccaggggtacatgctaccaacgtgacttatcactagtaatatcaacctcgtcgcttaattaggtagtgtttgccagattactccaccgtaaagttatttttccctactcaattttttttttttgagatggagttttgctgttgtcacccaagctggagtgcagtggcgcaatctcggctcactgccacctccacctcccgggttcaagcaattctcctgcctcagcctcccgagtatctgggattacaggcacccacaaccatgcccagctaatttttgtaattttagtagagacgaggtttcaccatgttggcctggctggtctcaaactcctgacctcagatgattcgcctgccttagccttccaaagtgctgggattacaggcatgagacgctgagcccggctcctactctatttttaaaacatgggtcactaactccagcccacaaccaagagggaagggattaggctttgtttcatggagggagaagtatctacatgtatcatttagaaatatgtggggaagatttgtcctttctccccatttatttatttattcattcatttatgtaatgcgtttggactcacgtacatttattttgttttgggttataatctatgatggttattattgagcgtcaacttgattggattgagggatgcaaagtattgtttctgggtgtgtctgtgagggtgttgccaaaggagattaacatttgagtcagtggacttggagaggcggacccaccctcaatctgagtgtgcaccatctaatcagctgccagcactggtagaacaaagcaggcaggagaagttgggaggacttgattggctgagtcttccagccttcatctttttcccatgctggatgcttcccaccctcaaacatcagactccaagttcttcagcttttggactctttgacctacaccagtgatttgccaggggctctcaggccttcggccacagactgaaggctgcactgtcagcttctctacttttgaggttttgggattccaactggcttccttgctcctcagcttgcagatggcctattgtggggcttcgccttgtaactatatgagttaatactccttaataaactcccctttatatatacatctatcctattagtcctgttcttctacagaaccctgattaatacataatccaattctgtgtatttattttgttgctcaaaattgtgtcagctttgatcattatagactttttaaagatgactcctgtgtgactttgatgcaccctccttgttttgtttcttgggcacttccttactctgagcctgcaagattcccaggctcaccttgtattttccctcctctatctctagaatcaaatcagccatttttccaaggacccctgatttcttttattagagaatggtatttagcaaccaagatctgggtgctgggtatcctccttatgactggagtggcattgcttctaaacctaggaacacaagctcagaaactcatgtgtctatgctaacccaagcatatacacacatatctcattttctgtctgtctgtctgtctgtctatctatctatctatctatctatctatccatccatgcatgagttcatacccatgtctccaacctaatcctgtatgacaggacacttccctcttgcttatttgtattttttttttttgagacggagtctcgctgtcgcccaggctggagtgcagtggcgcgatcttggcccccagggttcacgccattctcctgcctcagcctcctgagtagctgggactacaggcgcctgccaccacgcccggctaattttttgtatttttagtagagacagggtttcactgtgttagccaggatggtctcgatctcctgacctcgtgatccgcccgcctcagcctcccaaagtgctgggattacaagcgtgagccaccgcgcccggccgcttatttgtactttctttctgtgttagtgagaaccctggctcaggtctacctaaacttttgccagtaataatcactaggttttgaatggagacagaaagtaaggagacaatgtgccctcttcataatcgtgcatattaaccactgctccactgcgatatggctaggaacacagacactgaagctcgtcccttgggtttcatcccggcattgtcatttaatggctgtgtgatcttcggtaaatgacttaaactatctgtgcctcagtttcttctcctctcaaaaaagagtcataataatgaatatcccatagggctgaagggagaattgaagaagtttacacaagtaaacacttcagagcagtgcccgtctcatgctaagtgctcaagaattaactttagaaacaagtttataccaaaagatttatttgactgaaatatcaacagccaacaggggcctgacaaattaaaattttaagagtgtttgtatatattatttataaatcaatataataaataaagaaaaatagaccaggctcagtggctcacgcctgtaatctcagcactttgggaggccaaggtgggaggattactttagcccagaagtttgagaccagtcggggcaacatggcgagaccccatttctaccaaaaaatagaaataaataaataaataaacaaaacagccaggcgtggtagcctgcacctgtagtcccagctacttgggagcccgaagtgggaggatcttatgagcccaagaagtggaggttgccgtgagccgagatcatgccactgtactctagcctgggtgacagagagaaacagtctcaaaaaataaaattaaattaaaaaagtaaaaatatctgaaacagccttgacaaaggtacaaaagttatgttctgaatctatcattcacacatatgtcatttgagtgttatagctactctgtttgtctgtatccagcctgcactattttctttaaagtccagggttattgcactattttctttaaagtttcatggctataggtccctaattaaataaagtttgtaaagttgggcaaaatcaaaatattgtagaatggaagagaatattcagagtcaatcagggcagttttttatacattaaatgtataaaacccatttaatcagtaatgtggaacttgctcaagagaagctcaaggtcattgttaaacacacagactctcattcctttccttggagagtctgaggtaataaatctgagcctgggaataagaattttattttttattttattttatttcattttatttatttatttatttttttgagatggagtctcattctgtcacccaggctggagtgcagtggtgcaacttggctcactgcaacctctgcctcccaggttcacgccattctcctgcctcagcctcccgagtagctgggactataggcgcccgccaccacgcccggctaatttttgtatttttagtagagacggggtttcactatattggtcaggctggtctcgaactcctgccctcttgatccacccacctcggcctcccaaagtgctgcgattacaggtgtgagccaccacgcccggccttattttatttcattttttagagaaggggtcttgctttgttgcccaggctggtcttaaactctggacctgaagcaatcctcctgcctcagcctcccaaagtgtgggattacaggtgtgagccactgtgcctggccatgaatcagaattttatttttatgtatttattttgaggcagggtctgtttctgttgcccatgctggagtgcagtggtatgatcacagctcactgcaacctcaaccccctgagctcaagtgatactcccacctcagcctctcaaatagctggaaacacaggtgtgtgttcccacccctggctaatttttgtatatttttttagagacagggtatcaccatgttgcccagcctggtctcaagctcttgggctcaagtgatccaacttcctcggcctcccaaagtgctgggattacaagtatgagccactgtgcctggcctgaatcaaaattttaaacaagagttccaagtaatgcccatcaggcaaattccgaaaaactgatttaatccagatcctgattaatatgagaaaactgaggcccagaggaaagacaatctacctctccaatgttcattaagcatctacttctatagggcattacggaagtacaatgggaatacatcaaaaggtttgggacaatgcattgcgatgcatttctggtggactataaattggtacaatcttttgggcagacagttgggcgatatgtatcaaaatattaagtgtgcttatcctttgacccagtaattccagaagaaaatatttcttagagttttcattcagaccacctgaatcagaaccacccagggttcctgctgaggatgtagatttcaatgtctcagatcaactgaactagaatctctgggagtgggacctggcattctgcattttaacaagttcatcaagaaattctggctgggtgtggtggctcatcattattatctcagccctttgagaagtcgaggtgggagaatcacttgaggtcaggaatttgagaccaacctggtcaacataataagaccccttttttttaataagaaaaattagccaggcatggtggcacatgcttgtagtcccagcttctctggaggctgaggcaggaggatcacttgagcccaggagtttgaggatacagtgagcattgatcatgtcactgctctccagcctggatgatacagtgagaccctgtctcaaaaaaaaaaaacaaaaaaacaaaaaaacaaaaaaaccccaccaaactaaaggagagacttatgttcactaatttgtaagaaatgcttccctaacaaagggaagcagagggagagtcctgagctcaagcgatcttcctacttcagcttcctgaatagctgggactataggtattcgccaacatgcccagccaattttttatttttatttttttattttttattttattttatttttttgagaaggagtctcactctgccccccaggctggagtgcagtggcacgatctcggctcactgcaagctccgcctcctgggttcatgccattctcctgcctcagcctcccgagtagccaggactacaggtgtccgccaccatgcccagctaattttttttgtatttttagtagagacggggtttcactgtgttagccaggatggtctcgatctcctgacctcgtgatccgcctgccttggcctcccaaagtgctgggattacaggcgtgagccaccgcgcccggcctaattttttattttttatggagaagaggtctcactatgttgcccaggctggtcgcaaactcctgggatccttccacctcagcctcccaaagtagtgagattacagatgtgagccactgcacccagtctggataatttataatgaacaaaaacttatttggctcatggttctggaggctggaaagtccaagattgggaggctgcagctgataagggccttcctgctgcatcatcacatggcagaatatatggcatcacaaagaagcatgcacaggagacagaggaaaactgggctgaaatcccatgataattaacccaccctgactataacggcattaattcattcatggagcagggccctcatgacctaatcacttcttaaagggcccacctcagtaccattgacatgagttttggaggggatgtttaaaccacagcacagggcaaaaagggctacacagaggggcagctgggcatggggtattagagcccaagagggatccgaaaaatgtccacagggatggggagtaagacaagcagggtgaagatggtgtccccatagaggagtgtaccttgtacctgtgtggggtgtcagagccccagaagatgaggagatcatgtatatgagaggacaggggggcccggtatgggtgctaagagagggtgcctgtgcaagcgggtggcctgtacgaggtatgggagcctactgagggggttggccaggtgtgaggtgtggaggcctgaaggtacaagaagggcatctccttggggagggggcagtggcagcctcaggagattggctatgttcagggtgttgactaaatacataagtattttaaatttaaggagagtcaggtttctcactgttgtagaagagagttctgaatatggaagggaaactgtattactttgtttaaatgctgctgataaagacatacccaagactgagcaatttactaaaggaagaggcttattgaacttacaattccacctggctggggaggcctcacaatcatggcataaggtgaaaggcacatctcacatggtggcagacaaaggaagagagcttgtgcagggaaactcttgtttttaaagccatcagatcttgtgagactcattcactatcacaagaacagtacagggaagacctgcccccataattcaatcacctcccaccaggttccttccatgacacgtgggaattgtgggaattacaatttaagatgagatttggatggggacacagccaaaccacatcataaagctagaatgaatgccaagatgttggatttgaatggaaggaatttggtgaacttgtggttttcaataggtagatagatactatgtacctagacagtgtctaaactccgtctactaagagggtgacactccaatagcaatgagttctcctggaagcccagatctaactaccttttcccactaaagggaactggggcccttggagagatgacctactccagctctggaatagggaaatcataagacggccagaacatcttctcatgtcagaagacaaggaagtgctcaaagaatgtgggagccatgttaaaggacataggagccagcttgtggccaaaggagttcccactggccaaatctaagaccatttgagcatgattaaacagtgatagtgtagttttcaggagctggggagagagaggaatgcagttagtattgataggtatagagtttcagttgcagaagatgaaaaagttctggaaatggatgatgatgatcattgtacaacagtgtgaatgtacttaatgcccctgaattgtacacttaaaaatggtttaaaaaataattttgttatgcacatgttatgagaattttttaaatgatggcaatagagtataacatactaaataaaagaataatccatgagtcctgctgtggactgaattgtgtgccacccccctgcaatttatatgttgaagccataacctcccagtgtggtggtatttggaataagaaagtaattaagggtgaatgagctcataacggtggggccctgatctaataggattagtatccttataagagaagacaccagagagctttctttttctttgtgtcatgtgaagacacaatgagaaggcggctgtctaaaagccagggaatgagccctcacaggaactaaatctgccagcacctcaatcttgggcttcccagtctccagaacttcaagaacataaatttctgctttttaggccacccagtcaacagtattttgttatgtcagtccaagctaagacaagcccctaatgatttttttgttttgagacagagtctcactctgttgcccaggctggagtgcagtggcgtgatctcagctcactgcaacctccacctgccgggttcaagcaattctcctccttcagcctcccgagtggctgggattatgggcatgcaccaccacatcctgctaatttttgtattttgagtagaggtggggtttctccatgttggccagtctggcctcgaactcctgacctcaagtgatccaccaacctcagcttcccaaagtgctgggattacaggcataagccaccacacccagtgccccaatgattaaaaaaaatagtaataatggcaggaagggataggaaaggtctccccacataaagatgctggctcaaaaatgtagaagaaatcctgccgttttggagctatcaatgtaataattaattcaagcatggatcttcaatggatgtcaaatccaatgaatgaaagatttgatgaggaagaggatatccatagttttaccgtaccatccccacagacagttagttattaattgcagagggaaaagacgcctttaaaatggtgtcagatacacctgtcaggtaccacttaatgatcaaatttagtatcaccaatgatgagacaaaactgacattacgtacttttcaatgtgatggagggagaagtatacaacctccccataaagttttcttaacaaaaatgcgaacctgaatctaatgaggaaatactctaaaaccaaattgtgggatattggcctagattctatgtcgttgtcatgaaatatttttttttaaggaggtgaatgatcaagattaaaggagactgaagagatatgacaaccaagcttaatgtgatgaacttgcccagatcctgttttacacaaacagacaaaaaatagttacagggggtgtcttgaggcaatggaggagattttaatatgagctctatattagtctgttgtcatactgctataaagaatatatagcctgggtaatttataaagcaaacaggtttaatcggctcatggttctgcaggctgtataggaagcatggctggggaggcctcaggaaacttattgattatggaaaaaggtgaaggggaggcaggcatgtcttacgtggccagaacagaagagagggagaagggaggggtgccacacacctttacacgaccagatctcatgacgacagctcactcactatcaccagaacagtactcagaggaaacgcgcccccatgatccagtcacctcctgccaggccccagctcctggaaattacaattcaacatcagatatgggcggggacacaaatccaaaccataatcagctgtatactagataatatttgctgtatcaattttaatttcttaggtttgataatattgtagttataggccgggcacggtggctcacgcttgtaatcctagcactttcggaggctgaggtgggtggatcacctgaggtcaggagtttgagaccagcctggccattatggtgaaaccccgttatctactaaaaatacaaaaattagctgggcatagtggcaggcgcctgtaattccagctactcaggaagctgaggcaggagaatcgcttgaacccgggaggcagaggttgcagtgagccaagatcatgccattgcactccagcctgggtaacagagtgagactccatctaaaaaaaaaaattatggttatataggagaatggccttattttcagtattgaagtatttagaagtcaggtgtcatgatgtctataatttattttcaaattgttgagcaaaaaaacctacatctccatagagagaaataaaagcaatgtggtgaaatggcaatctctcctggtgaatctggaacacagatacataggtactcattttattattgtttcaaagtttcaacaattttcacatttttcaaatgaaaaagagtctaactctctgggatgtgtctcaagaaatacataggtcagatttcttacttattttttattttattttatttatttatttatttttgagacggaatctcgctctgttgcccaggctggagtgcagtgcacgatctcggctcactgcaagctctgcctcctgggttcacaccattctcctgcctcagcctctggagtagctgggactacatgagcctgccaccacgcctggctaatttttgtatttttagtaaacatgaggtttcaccctcttgcccaggctggacttgaactcgtgagctcaagtgatcctcccaccttggccttccaaagtgctgggattacaggcatgagacaccatgcccggcccaatcctgtcttttaaagaaggtattttccagactataaagttggaacagaaaaaaaggatgcaaattaaagatggtcaaaggaaaacagaatctcatattatttcattacataagaaataatgtaagccggatgcggtggctcatgctgttatcccagcactttgggaggctgagacaggaggattgcttgaggcaagaagttcgagaccagcctgggcaacatagtgagatccccatctctattttttatataattaaaaaaaataaaagaaaaaaagtacatgaattattcaccctaaagccctaccctacagagaatacaagaggtgccctctgagaccctcatatgtataaaaacgtggtatttgagcttctgcttctttttgctaatgagacagatactttaaatgttcacttctttttttttttttctagcaaccacaaaatttgcccaatgtcggtctcctacctgcagtaaataaggtaaaacagaatctgtttgatgttccttattattaaatgggaatgactttttgcctaaggtgttggtgtaatcattaactgcaagggaagtggttatggtaattgaggattctggtttgacccagctgtgggaatttttttttctttttttcttttttgttcttttttttttttttttgagacagggtctcgctgtgttgcccagaccggagtgcagtggtgcaatcttggctcactgcaacatccacctcccaggctcaagcaattctcctgcctcagcctctcgaatagctgggattacaggcatgcgccaccacacctggctaatttttgtatttttagtagagatggggtttcactatgttggccaggctagtctcgaattcctgacctcaaatgatctacccgcctcagcctcctgaagtgctgggattacaggagtgagccaccacgcttggccagcagtgggaatttttaaagatcacatgcctttcttcttaaggactgtctagacaataaaatttagaattgcggcttggggttacctaatcacaataattagagatatttgttttaaccagttcagttgccaagaaaaaaaatgccactagtttgattaagaaacaaagcacattcttttatttagaatttgaaaagtgtataatccctgatctccttgaagaaacaagggatattaaaatattgaaaaccagttcatcttgtcctacacagagctgactcactagcatagtgaagacggttcatacactaacaactaattcttacacacataactgaaaatgtagaccacattgtacaaagaaataaaattatatcaaattgtggaaggccaaaaataggattatagatggcttacttaattctatttgacttgcactgatgtttccctcccaaggttcactcctgcatactcagttctctacagacttttagatgatagacattcagccatatatttgcagtcctgacctttgcttcgagctttagtcctgacctttaactttctgctgggtatctctaatttctaaagtcaactgcatctcagatccccctttggacttcctcattttttccagccctttgacagtctaaaatcttggattcacctcagattcctccttctagcttatttgcctctctcttcttaatctaatcagttgcaaattcttgccaaaccatttcttttcatccttcattgccttatttctgatccagaccttatctgtctcatacctgtactatcacaacagcctcctaactggatgcctccagccagtcttgggctctttcgtgctagcttcatctttgaactttgcacacccgtttctttcctcaaacatgccccgccacgcctgtccattttaaactcatgtctatgctcatctctccccatcctttttctttaatgattatttacctcatgatacttctctgatggatctccctgacagcactaatcctctataagaatttccttcctttactatctgtgttcttcctttgacaggaaggaagtgtacaggaggctgtgttctttacattttatgattggccccatctccagaactgactagattgtaacgccactgaacttagccagccaagtgtctttttgcaccttgctttttttcacttaacatatactggagatctctccttaccagcacatatatgtttatctaatgcttttaaaatgcttgctaactatggataattcataatttatttaattagtcccttaccgatggctactggtggtttttctggctttgttattatcaaacatgcttcagtgaatatccttgtatatcttgagcaactttaatgtcacaggaaaataattgtactgggattgctggattaaaggggtgtgtgtgtgtgtgtgtgtgtgtgtgtgtgtgtttacatataaacattttttttaagaggtagggtctccttatgttgcccaggctggaatgcagtggctattcaaaggcacggttatagtgccttgaactcctagcctcaagtgatcttcttgcctcagcctcctgagcagctgggactataggtgtgcttgatatattttatttttattttattttttttagatggagtattgctctgttgcccaggctggagtgcagtggcaggatctcggcccactgcaacctccgcctcccaggttcaagcgattctcctgcctcagcctcccgagtagctgggattacagctgcctgccaccacacctgactaatttttgtattttttagcacagacggggttttgccatgttggccgggctggtctcgaacccctgacctcaggtgatccgcccacctcagcctcccaaagtgctgagattacaggcgtgaaccaccacgcccggcccacctgatatcttttaaatttgtacataatagaattatcttttaaaataattttcactgtctactcccatttttgatattaccaattttcctgccactcaagattaggacattgacagtgggagctttgtttatggtggcttatccccacggatttagcgctggagagaaaacgtaaagctaggagaaaagaacattttgaaagccacagaataggctcttcagcggctagaacacggttccaggctagggcaatatggcgtcctgtacaccggattgcatcatctttctttgccaaggatcatctggagctcaaatcaaatctaaatgtgtccacctctaaaatggggataatcttcatgtttcttttccttttacagatataaatgcaatttcattgtcttgaccgttaggaattctctgaaggtctgttactacgtaaattgtgtgaactccgaacagcagagttcaaacttgatcagaacaaaaaaggctagagagtggcaactctcctttccgtcattttaatggcttttgtatgaccaaatgtttccttgccagtcagtggggaagaagcagcgagcttgtctcttaattgctttagagttctgtttgtctatttagcgtttctttttgaagtctgaagatttatggaacaataaacgtcatttaatgctgcgtgctattttggattcctcactggttttagaatttgggtaaaactacttagctgaaagtttaacaaatttgaaattacaagtattgtagaatagttcatctcagtgacataaaattacggcagcagcaaagtgtgttactttggttttttttttttaatagtaagatgtagacattttagtataacaaatgttttcaagttgtttgggaaataaataagctaggaagcaaggtttaaataagaatggtttggtttggtgctgaatgatgttgttagtacaccgcaattcaagtgttggctatgcatttgggccaatttagggaagtccaaaacaacgcacattcgctcagtagtgtgagagattaattgtaggcaggtcccatcttttttacagtattcaaacgttcaaccttaagaccccaccagggcgtctcattccaccgggaactagagaagcttgacttgtgtgatcacctcctgatgaatggactggggcggaacacagatccggaggtgggggcttctcttcaccaagcgcaaagcctaccttccagaaggctggctgcacaagcggccgccctaaatgcggtcaaagcgggcaaattcgccgtgggtgccttccttccctacctccggcccactctggttgctccttcccaggtgctccaagctctccagagtttctggtggtttaaagtttccgcttcacgcccagactgctctaagggcaaacacgacccctttcctcttctaggaccccttccgtgaagtctgttccaaccctgagcctctccaccttcgagattggccgcagatgccccgacgggatggcctggggagccgaaagctgtccccagccccggacagctactgcccacgccgcgcaggccagcctcacacagtagcgaatctccttcacgcgacttcctcgcaggcctgtgaacccgcaggggaggcggaggtcggttcaaaccctgcgagagcccctgcccagcgcggagtcctgcacacggtggaaagtccttacgcattagcgggcaggattaaacgacttcacaccacgaggtgcaagactgggcttcggggccttcctcggtgttgctattttaaaagaagctgctcagtaacccagaagaagatgacgggggacggtggtgtagacccggctggagaggagtccagggcctgggaggcgccccctctgactgaggggctggggaccctgaagcttggcgtccaggccccgccagcgctgcacccggcattgtcccgcctggggcaggcgtccggtccctcggcagtgcgggccagcacgtacgtagtagctgctgaataaataaatgcctatgcaacagggaacgtcccggcccaccccggccgggccagggcctaggaagggcgggcgtccggcgccgccgtgggtccctccggcgtggccgcccacacctcctggccacggcggggctgcggtggggggacatcctggggcgggcggctggacggaagggactagagtcggggcgcgtccacggccaaccgccccgaaccaagcaggggaggccagggaccaggagcttccggggccccgcggctggagcgcccggacgcgaaggggcggcgggtgacggggcgcggtgcgggcggctacagggccggacgggagttcctccgctttccgccgcgcggctcgcggtctcagccgaggtcatcgagggccaggagccctggcggaggccccgccgtcccggacccaccgacgcactcccagggcttggcgctttcccaccaccccggaccgcccttggggtgccggaggggctcggggcgcggcgtggggagcctttgtgccctctccgcttgttgaggttttttctccggaggagagctccccgcccgccacccctttcctctcgaaagttttgtggtttccctagaagacgaaagaggttgagaaggttgcggagacttttgcaatcttccccgtccagaaactctaaaacctctcggcgtttggcccaggggagctatctggggtcaaggggagggagctggccgcacattccttcgcccgccttcctcccacctggagccgcggccccgcggggcagtgcgtccgagctggtgcggcgacgccggcagcggcggggttaagctcaggaatgcggcgcgaggaatgcgcatgcagatgaggcgggcgggcgcatgctaatcgcatgcaaatgaggggcccgccgctgccgcggcagcgccgcagcttcccggatccgagcccagacggcggcggctccggcagcctgggcgccgcgaccctcggcggccagagggggacggggcggaggaggaggaagaggcggaggcagcggcggcgagggggaggagggttcgctcgccggctccgacgcagacatggtggactgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggtgggcgccggccgcgggggcgcgggcccgttcggacacggcggctgttgtcccggagacccggccgcgcggggggctggggcggcgccggcccgcggtgccccgaggggtcccgggagggatgtggggctggctgctccggcggggccgaggagccgcccgtacccgggctcctccgcccaccggcttcccgacgcccctccggggacccggccccgaggcaaggctggagtcgctgccccgggccgacgccgcgcgccaggctaacggacccgaggggccacctgagccctgttaggaacttccctaggcttcgaggtgcccacgtggaggctgcaggacaccttcggcctctgggcggcgggggtgggctagggcctcactgccagttggggaacgagccctccgggccacctgtggcatccctcaggccgtccttggcgcgggagcctgggctgcgagctcttggcgggggcgcccagactggccggaggtcccgagctgggaaggggctcccgccccccgccgggccctgctagtgggtgtgactgactttgcccctcagagtttaaaaacgcgcgtttgggggtttcgctgtctgtcgttagtcttcacctgaaaacttgaaccgactcccagatcgggaacaggcatattgtgtttggaagggagatgtagtgaaattaacgttgggtattgaggcactctgatttgagcttagcctggtttctttgttttttgttttttaaattggttcaggaactgaaggttcacaaatgtttctgtgtcccatattttttttacccttaaaatttcttagaattattgtaagaataataggaggtattcctaattataaatttgtaaattatccattaaggagatattcctaattgtaaatttaaataacgtgccaccagggataacttcgacatttggacttttgtcatttctgaaaattataactttattgaatgtggccctttgggctttatatactttttaggtgcttctcctatttaacattttcccttttctcaatttgaagctgaaatacctaactactttataatctcagttacttttgccctaaaaatgttgtttttgaaagctactaaaaggcaattacaagaaagttataaataacattataaatttatggaacaatccttgttcaattatccgtgaagctacgggcctaggtttccctcctgaaatgagaaaaggcacctgtgctgaggttcggtcttgccgcagcctggctgcctgttgctggcctgatgaaaattgtgacaggcatcacaccttcccagtgtctccagacgtgctagttgttgtcataaacttcacgctccaagccagttatttgacttatgctattgcactttgaaactacttaacagatagtaaatgtcagtgctgatggtgtgcacccaactgcggcttttaaggcacctgtataaatatttgacttttacagttgtgtggtaattctttctgctttctgatacttggagtttcaggtaattgaaataacaataaattcttgaaatatttaggcattctaggttctcttcttcggtttacatgctttactatattatctcagttgtgtttaccggaaaggattacaagaatatgtaatgtctgggtaaagtaaatagaaagtggagtgaaattatatgacttggctatccatatcactacttttttcacaagtcaagcatgtcctttattttaaactcttaatggattagtaattattatgaactattttcaggaaactggataaacaattcattggatagggacaaatagttttgactaagatagctttttatttttccaattttccttgcagctgttaggtcttaaatattcagagacataaatttgacgacttacaaatatttctggatctcagagttttaaaagatactctgttgagatcagagtcaccattatatactcagtttaaatttgattatattttcttttagggcaattaagtgactaaatcttactaaatagagtaagagctgatgggaacgtatatttggagtaactattaactcctgtcagttttgttacacacttaccaaacatatggaaagagagatgttacacaggccaataggagtgtgtggattcttctgcaggatcaacttacaaattctgaaagaaaaacaacttgatatactatgggtctgcagtacttttgaactgtttaagccatttaattagaatggtcacgatgatttaccttgcatattttttatgttattctgttaaggaaaagaattttgtgtttttgatagtctatcagaatttgttgaatatttctgattatacagataattatgccgatttagtaggggaggctagggcattttataagaacataatttcattcaacaggtagtcatgccagaatgctgaagcattattctaaaatgcttttaagcttttggaggtgaatgacgtcattcaaactttgctgggatgtgatcaaagcttttattgctccacttcttacttttattgactaagtttacgtgagtttctgaatccctctaaacctccatttttcagctctaaaatgaggataatatcatcttcttcataggggtgtttgtgggctcaccattagggcccagcctaattgtattagtgtagtgttgacattccagtttaggaactgagtgaccctggaaatagtagaaatactagcatggacagtatttactcagtgtgtattgtgtgctaggcactctgctaagctctttaactgtgatctcatttcattctcccgttggtcctgtgaggtaggtactactgtcatcttccagttacagatgaggaaattgagtcacagagaagtagcccttgttaagtgtggagctaggatttaaagccagacagcttgactctacagcatgtgtccttaatcattcctttaaattgtctcgacgcttgcgcatgttcaggggtctttgggtggagtgcacagaggggcagaacctttttgcccagtgtttatttttcaggctgagtgactaggctaatcctggggaaatctccctgtttgtgattaattccttgtccccctaccctgcctgcatgggcccactccccgagtgttattttgtaggtttaccccctcttcttttgctcaccatggacccttttgaacataccagttggtgtttatggtaggccataggtcttggccaaatggcctggtgcttttttttttttttttttaattacattcaacaaaggagaaaaaggtgggatggattggcttcattgccttttggaggagtagggagcttaagtgggcaggcctcagagatagggtgggttggctttaccaactcccagtagaattttgctcattttctatccttggattgaatgttacccagagatacaatgactttgtctagttgaactgaaagatttcacaccatgcaaagtgactttccattaaaacccactgatagacactaatctgtggcttatggcaagggtcagatgttgagcaacctgtaccttctaactgaataaaaataatcttggggggtggggagggtgaaaagggaggaagggggtgccagctgggtatatcattgatgtcacagttaacttttggctctccacacccgtttgaggcatatgactaggatcagaggaactctgtattgtctttttttttttttttttttgagacggtgttttcgttctgttgcccaagttggagagcaatgacgtgatctcggcttactgcggctcccgggttcaagcgattctcctgtctcagcctcccgagtagctgggattccaggcgcctgccaccacgcccggctaattttttgtatttttagtagaaatggggtttcaccatgttggccaggctggtctcgaactcctgacctcaggtgatctgtctgcctcggcctcccaaagtgctgggattacaggcatgaaccaccgcacctggacttgtgtttctcttttttttttttttttttgagacggagtcttgctgtgtcgccagactggagtgcagtggtgccatctcgcctcactgcaacctccgccgcctgggttcaagtgattctcatgcctcagcctcatgagtagctgggattacaggcaccaccatacccagataatttttttgtatttttggtagagatggggtttcaccatgttggccaggatgatctccatctcctgaccttgtgatgcgcccaccttggcctcccaaagtgctgggattacaggcatgagccaccacgcccggcctggccttgtctttctttcaaagtctaagtaatttctttttttttgagacagagtctcacattgtcgcccaggctagagtgcaatggcgcgatgttggctcactgcagcctccacctcctgggttcaagtgattctcctgcctcagcctcccgagtagctgggattacaggcacctgccaccacgcccagctaatttttcgtagttttttttagtagaggtggcgtttcatcatgttggccaggctggcaaattaagtaatttctatgaacccactgctagactgtaaactcctggagtccccgattgcttattactgctttttgaatcctttatacatggtatgttaaataaatgttggttaatttagttaatgaagacagtttgttaaattaatgaaagaatattaattgagctactctcttatttccagattcttactgttgggctttcaaaaaataaacccatagccaccaacagagacaactgactttccagttatatttaaaataataagagaattgagctgctacattttgagtaatagtataaatatgagaattacttataagagcaaagaaaacaaaatgaaccttgatagtcttaatcacaactgccattgtcatagactgctggaattgttcctctccagcaggccctgagtctgggtgccaagtggttactgtgaattatttgagtgattatagtatttgaagtgtggagaggttgttaaaagaggattaaaaaaatcactctaggaagcactaatttaaagtatgctgtcttccaaaaattccaaaagaaatattctttttaacacagtttggtataatgcttgctggagtgaacagtactatagttgcttagtatattggagggtctaagagttctccagtgacattaatagtccatagcttgcagtgtaattttgttggaagactcaggacaataattgctttttaaataaaataaatattttatttatttattttttgagacagagttggctctgtcgcccaggcgggagtgcagtgacacaatctcgtcttactacaacctgtgcctcctgagttcaagtgattctcctgcctcagcttcctgagtagctgggattacaggtgcacgccaccctgtacccggctaatttttgtatttttagtagagatgcggtatcaccatgttggccaggctggtctcaaactcctgacctcaagttacctgcccgccttagcctaccaaagtgctggcatactattatctttaaatatgttatttgttttgagctgcaaatccctaagcttcatctacatagtcagccattgtgacatgtggccttcaacaagttggtatttaaatttaaccagaggaagcccaggtgcaccaggaaaagcgtggaagttgtctgttggcccacactgccgggccctgcattgccttgtaaatggctcttgcttacttattttcagtaattgtctgtaggaaaatgagattatcactttagaggggcatggccagcttcttcttgccgatgcaggagttactaaattagcaggaaacagtgttagccctaatacactgtgaattccttatgatagggcttgagtctgtatgtatgccctggttcctatgaacttgattgaaattggttaaactgatcttgtgttagaattttggacttgccgggcgctgtggctcacgcctgtaatcccagcactttgggaggccaaggcgggtggatcacgaggtcaggagatgcagaccatcctggctaacacagtgaaaccctgtctctactaaaaatacaaaaaatttgccaggcgtggtggcgggtgcctgtagtcccagctacttgggtggctgaggcaggagaatggcgtgaacccgggaagcggagcttgcagtgagcagacattgcgccaatgcactccagcctgggtgacagaacgggactctgtcttaaaaaaaaaaaaaaaagaattttggacttctttatgcatttctaaactcctgttactgaaaaagttaccacagaataatgtagaagaggaaagggattttttttttttgacaagagttttattcttgttgcccaggctggggtgcagtggtgtgatttcggctcactacagcctccgcctcctgggttcaaggttcaagcaattctgcctcagcctcccgagtagctgggattataggctctcgccaccacgcccagctagtttttgtatttttaatagagatggggtttcaccatgttggccaggctagtctcgaacttctgacctcaggtgatctgcccatctcagcctcccaaaatgctgggattacaggcatgagccaccacgcccggctgaggaaagggatttttaaaggcacagtgtgtatgtaagttgtgagatacaaatgatttatcaaaatataggttcacaatgttttcaatgtcttcagtgattttttccaattattttatctttattagattaaaaaaattcctcagcataaaattattcattttaaccattttgaagactacaccttagtagtttttagtatattcattgttatgaaaccataaacactgtataattcctgaacattttaatcacccccaaaacaaacgaccccttacctattaagaactcacttctcattcatctcccgtctctacagctttttgcaaaaactgatctactttgtgtctctgaatttgcctattctggacattttatataaatggaatagtaaaatttgtatccctttgtatctggcttctttttttcttagtgtaatgcattcagggttcattttgtagcatttattgtactactgcatcattttcatgacttaataatattcgattgtgtagatataccatattttgtactttcattagctgatgtgcatttgggtcatttccactctttggctgttatgaatgatgctgctatgaatatccctgtacaatttttgtatgaatgtgtgtcttcagttctcttcagtatatacatgtctaaaagtggagttgctgggtcatatggcagttctatgtttaactttttgaggggactgctagactgtttaccaccattttacattcccaccagcagggtatgagtgtgcaaattcctccacatcctcaccaacacttctctctctttctctccttctctcctctttctgtctctctcttctctttccttctcttctcttctctcttttctttttttcttttctttcttcttttgagacggagccggtctctcttgcccaggctggagtgcagtggtgatctcggctcactgcggcttccacctccacctccagggttcaacagatcctcccacctcagcctcctgagtagctgggattataggcacaagccaccatgcctgggcaatttttgtatttttagtagagacggggttgggccggtctcgaacttttgacctcaagtgatctgcctaccttggccttccaaagtgctaggattacagatgtgagccaccacaactggcctcacttctttcttttttttaaaaagttattttagtgggtgtgaggtaggatcttactgtggtgttgatttgtatttccctcttcgtagtgttttgatggccttagttgggcccaagcctccccttattctagccttttatagctgttgctattctgccccctttttgtttgtgtactctcactcttacttgatcaataaaaagttaggtaagagaagttagagggtttttttagtctcacattgctcttcccttttctccctatctgattgctttgagtgattatttaatactgacattgtagatatgcattaattaacagtttttattgtatcaaccagccaggtaccctggactctgggagataaagatggataagatttggtcccagctcagcttgcctacaatctagtgtgcataatcatcatttaaaaagtgaaagaaaattttgagtattatctgttaaattttctctatattcctatatttcagtttaagggtaccttcttcctaaacactcagagggaagacagttgaaaggaattaaaagcagaatatattggcaaagtatatattaatttttttctttatttcaaatgtgatgtattttatgaggcatttgtgtgagtcacgtaatgaatcatatgtgcaatgtatatacatcagcttattcaaaatgatttgacatgtaaaggcttttccttttagctcgttatatatgtgaagaattaaatttatttttgttcattgtttttttaaaaaatggcaggagcaaacctgacaagcgctgcctccatcaggtgatcaaagggaacatccagggcactaagtcctgctgatacacccttgatgtgatgtggtgacaatggcattttatctttgtggtctttctcccccaaaaccgtagtaactccagtctaatcttgagaaaaacacctactggatcccagtagaggggtatcctataaaatacctgaccagtacccctcaaaaccgtcaagatcctcaccaataaggaaagtctgagaaaccctcacagccatgaggagcgtaaggagacaccaagactaaatgtaatgtgtcccaggggtggaggagtcctgggctggaaaaaggacattaggtgaaaactaaggaaatctgaataaggtatggattgtagttaaaattttttttttttttgagacacagcctcactctttcacccaggctggagtgcagtgttgtgatctcggctcactgcagcctcagcctcccgggttcaagcaattctcctgcctcagcctccccagtagctgggattacaggcatgtgccaccacacccagctaatttttgtatttttagtagagatagggtttcaccatgttggccaggctagtcttgaactcctgacctagtgatctgcctgcctcggcctcccaaagtgctgggattacaggtgtgagacaccacacccggcccgattgtagttaattttattaatgttaatagatgtaccataccaacagggaaaagtaagtgtggactatatatggcaactttccacactaattttgtggttttttttctataaatctaagactgttctaaaaaataaaattttaaaagacctcttaaaagtcacacaaaacgaagtgattttctttggtggaagcataaccatgtttgttgtttatatgaaaattctgctttgtaggcctcattttagccctccagctaagaatgggttttaaatcatgaaaagctgtaaacaaacaaacaaaaataaagaagaatatgtgacagagactaaatgtggttcacaaagcctggaatgtttactttggccctttacagaaagagtttgccattgtctttaaaaattttatagcaatatttttaaatgtttctataaatattaaccttttatgataaaatggcacatttattagtgatcattgcacattcttttatgccagcagtccccaacctttcaggtaccagggactggttttgtggaagacaatttttccacagaatgggattggaggagttgcgagggatggtttcaggctgaaactgttggatctcagatcatcagggattagttagattctcataggagcgcacagcctggatccctcacatgtgcagttcattatagggttcgctctcctatgagaatctaatgccaccactgatctgacaggaggcggagctcaggcggtcatgcttgctcgcaccacacacctccttctgtgcggcccagttcctaacaggccattgaccggtaccagtctgtggctaggggttgggaacccctgatttattccacaagggatttggactctaggtactgtgtgggacaaaggtgagtcagacatgggtgctgaatttgaggagctgtcttgtatctcatgttacttttttttttgtttttaaaacaaggaaatgcagcatgttacttagtttcccaaactggttctttgaattagctggacctaatggtagtggaaataggtctgttactcttaaggtaagaatgatttcatgggtccctgttcaaatgtagcagcctgtggattctgtatacctcatgattattttgatggaaaatcaagagacatctctgggcacctggctttgccatggcagggcctaaagtagagattgcttttgtggtgtagagacagctcaaccccagtcactcaataaagttaccagataccaggcgctgctatataattcttaagaagagttgtacataggacatgagaaaaacaggcaaaatgaatttttggaagtaccatagttgtttgtttatacttgactgttggaagtatatagtattatgctttggtagttagaaatactgactttcttgtggcatattgataatatttataaaattactaggtgatgatcaagcaaaaaattattccatatattatccttgtgatgcctgtcactttgaagcatgtcccaaagactgctctgtagagctatttttttttttttttttttgctttgtcagtaatttttcctatactttttgccctgatgtcagtaaacaaatcatggttccaaaatggagccagctcagaagtgaggtagtcatgcactaacagagttatgtattgggagctgttttttcactcctgtagctcatgaggaattacaatagttccaatagagcatttgaataaaggtgtacatttaatgtactttggtttcactaggagtggaggtaggaaatttaattttaaagaagcatagacattgtgttatgacaataatcacttttaactaagtaagtgtccctggtatttttgtgaaaatgagtatgtcaacatttggaaggcaaagaggctttcctttggtgtgaactttgctcctgctgcatgtgcagtgttgttttctggtgtggcctgggttgtgttggtcaccagttctgaatgtgaacaacagaggtaaacgttgaattatagagattggtgctacaaacccctgattaaaatcctgatttacagggctgggctcggtggctcacgcctgtaatcctagcactttgggaggctgaggcgggcggatcacgaggtcaggagattgagaccatcctggctaacatggtgaaaccccatctctactaaaaatataaaataattagccgggcgtcgtggcaggcgctggtagtcccagctcttcgggaggctgaggcaggagaatggcgtgaatccaggaggcggagcttgcagtgagcggagattgcactactgcactccagcctgggcgacagagccagactccatctcaaaaaataaaataaaattctgacttactaatggactgtagaatacgttgcatactttattgacagttgtgcattttataattgcataattggtatgaagtggcagtgatattcagttaagtttaaaatgtggtagacaactttgcacaagatttgaggagcatgtagtttcatttagtgtgaaacttgaatctactctgcagttttccttagcattatggtttttaatagagatacattagaattccagtctttttttttctttgaaactgtgacagtgaatgaatgtgtggaatctgctttgtacatagtatcactgggttatcagctttgttgacttactggtctaggtgtaattttgggctggttggtaattctgtccataccatatgttcttttcttatctgctgcttatcagtgtttgagtttgataaaaacagatcatttactttctgttttgtttttttttttttgataccgggtctcactctgttgcccaggctggagtgcagtggcgtgatcatggctcgttgcagcctcaatctccctgggctcaggtgatcctcccacctcagcctctggagtagctgggactacaggggtgcggcacaacacctggctaagtttttttgtactttttgtagagtcagggtttcgccatgttgcccaggctggtctccaactcctggcctcaagcatttctcccatcgtggcctcccaaagtgctgggattacaggcgtgagccaccacgcccagccagatcatttacttttttccttctttgtctcccttccccttttctgctaaatgacatagctaatgatatttctcataggacagcatgactagaaaccagtatttaacttggcagaatgtttaacataacatcagtgccctggtttgctattgtagattgaaagactacaaaactaacttgattgtctaactctactttcagtccttcatttacccctgaaggtatgcctgtagaacgtatgtagatgcattcttgagagatttcctagtgtctcatgtgtaaggagcttgtgtgtgtctgcatcactaatgttttcataaaattgattctaagttatttgagaatagagacctgctttgtgtgtgccccttcatgctctgtgcttagattgcctgtccccacagggacacttaacacggcggaggcctgtacccatagaaatgaaatgtatgcatttgaaggaccttttccttcttccagtaacctccataatttgtccccagcttactttactgacttcaccacctagtcattcactcagtcactcattcattcattcaatcaaactattcgtcacacatttattggaaacactatatgcctagcacatacatttcggggacacggtgttgaatgaaataggtgagatctctgttttcatggattttatattctactttggggaaggcaaacagattctaaagatagtagtgaatttgctttgattaaaataaacaagatgaagtgataatagtgtcggtgggagctgctttgggttaggtgatcaggaaaggcctttctgaggagctggcatttagctgagctatgaggataagaaggagccattcatgtgaagatctggggggaagagtggtctaggcagaagaaaagactaaacagaagtactagccctgtgctttccactatgataccttctaggagtatgtggctatttaaatttaaactagttaaaattaagttagaaatttagttccgccgggcacggtggctcatgcgtgtaatcccagcactttgggaggccgaggcaggtggatcacctgaggtcaggagttcgagaccagcctagccaacatggcaaaaccccatctctactaaaaatacaaaaattagccaggcgtggggtgcatacttgtaatctcagctacttgagaggttgaggcagcagaatcacttgaacctggaaggcggaggttgcagtgagctgagattgcaccactgcaaatacagaacgtttccatcagcacagattgatgtagaaacagagggaggagggtcttatgaaatgaggcagagaagtattaggttggtgcaaaagtaattgctttcaatgcaaaaaccacaattacttttgcaccaacctatagaaaggggtcctatcatgtatgccttgtagaccatcaagattttaaggttgtttgggagctattggagagttttcaattgaactgaggtaaggtggggcctgtgtgtgtgtgtgtgtgtgtgtgtgtgtgtgtgtgcgcgcgcgtgcgcgcgcacatgcacgtgcatgcaagatgatcttactcatttttgtttgttggtagagacagagcctcagtatgttgccaggctggtctcaaactcctggcttcaagcagtcctccctctgcagcctcccaaagtgctgaaatttacaggtgtgagccactgtgcctggcctttctttttttctttttaaagatcttattttaaaaaagagatcactactctatggagaaggaattacagattttttttttttttttagtgagataatctggatgagaaacaatcagagcttgcactagaatgatggctttggcagtgggaagcagtgagtggatttgcttttacctaaaaaacctatgtttttttggtaaaaatgaaagaacttgctcatgatgtgggtacatgaggcttgaggaaaagagagaataaaagagttaccattagggaaagaccgagggagaatgtggttggttggtatccatttggattgctaatccaaagttctgtttccgatgtataggtgtgatagagtttgaatatgtgtccccactattgtaatttgtaattcctagttggaggtagggcctggtaggaggtcgggtagtgggtgagttcttgcagtatctggttgtttaagtgtacggcaccacctcctccccccgccatcctctctcttgttcctgctctggccatatgatgtgcctgctcctcttttgccttctaccttaattgtaagcttcctgaagctcttcccaggagctgagcaggtgactggggccatgctttctgtgtagcctgcagaagtcataggtccaattaaacctcttttccttataaattaccccatttcaggtgcttatagcaatgcaagaaatacaaggtgtgagacccctatgaagacatacaaatagagaaatctagtagacacccagatatagaatcttttgttcaggagacagctcagagctagagatactaaatttggtttatacataggtagtatttgaagttgtgggatgggatgagattactggaagagaggaaaaggagaggttccaagattgagccttgagacatggcaatattttttgtgaaaccttgtttcagctaagatggtttatttgttttcactggaacatacctttttttttttcttccaacgtttatttcaggttcacagagtacacacgtggatttgttaatgtgggtagatagtgtgttgcgggggtttggtgtacaaattatttcatcacccaggtaataaacatagtaccccgtaggttgtttgtttgtttgtttttgtttatttatttttgagccagtctcattctatcgcctaggctagagtgcagtggcaagatctgtgctcactgcaacctctgcctcccgggttcaagcgattgtcatgcctcagcctcctaagtagctgggaatagaggcgtgcaccaccacacccagctaatccccataggtagttttttgatcttcaccctcctcccaccttccactctcaaataggctgtgatgtctgttgttcccttttagcttccatgtgtactcagtgtttagttcccacttataagtgagaacatgcggtatttggttttctattcctgtgttaatttgcttaggataatggcctacagttccatccatgttgttgcagagatcatgatttcattcttttttgtggtgcatagtgttccatggtgtatatgtaccacattttctttatccagtctacccttgatgggcctttaggttgattctatgtctttgctattgtgattagtgctgcagtgaacataaatgtgcatgtgtctttgtggcagaatgatttgtattcctgtgggtatatacccagtaaagggattgctcggttggatggcagttctgttttaagttctttgagaaatctccaaactgctttccacagtggctgaactagtttacattcctaccagcagtgtttaagcattccctttcctctgtaacctggacagcatcttttgacttttatctaatagccattttgactggtgtgagatggtatctcattgtggttttgatttgcatttctctaatgatcagtgatgttgagaattttttcatatgccttcttttgagaaatgtctgttcgtgtccgttgctcattttttatggggttgtttgttttttgcttgttggtttgtttatgttccttatagattctggatttcagacctttgtcagatgcatagtttgcatatattttctccaattctgtaggttactctgttgatagtttcttttgctgtgcagaagctctttagtttaattaggtcccatttgttggttttcttttttgttgcagttgcttttggcctctttgtcatgaaatctttgccagggcctacgtccagaatggtatttcctaggttttcttctagggtttttatagttttaggttttacacttaagtctttaatccagctctagttgacttttgtatatggtgtaggaaggggtccagtttcagtcttctgcatatgactggccagttatcccagcaccttttattgaataggaagtactctccccattgctcatttttgtcaactttgtcaaagaccagatggtggtaagtgtgtgactttatttctggtttttctaacatgttccattggtgtgtgtgtctgtttttgcaccattcactggaacatatcttatacttttcaccactgtgctaaagatgatgatgatgacaagtaccataagttatgtgaagagcccttcacatatttatctcaagcttcatgagggcaggtattgtgtctgtcttgttcactactgtattccaatgctcagctttgtgcaagctcttagtaactattgaataaaagaaactttgataggtaccattattatttccattttaggaaactgagactgaagaggtttaagtgacttgtctaagggcacaaagctgttaagtggtggcagaactcaagcgtgtctgtctgacttccaagctgtacatctaacaagatactgccttcgattcctgctaggaaaggcctttggccgcctccctggctttggaagatagagcctccttcaggatttagctgaagtttcatcacttaaagtttgccttaacaacttagccacacataatcttccagtgcttaattcttatgctacctgtttttagcatctgtattaaaactacatgtgtactgtattttgactccttgaattaaactattactttttcagaatttattattttctcaaattaggttataggctctgtttagttaaatcatgcacaatattatttatttatcctgccttgcaagatacccagtacaatgtcttgtggatattagttgctcaaataaatcctaatttgattctgtcatttctgccttgttccagtgttttcagttcttttagaggctgagatctatatgctataaatcctcttcattcctgtcctgtctctggttctaaaaacggttcagtgttgtcccacagcttctcccaatctaggcttctgtggaaccatctccttttcaaatgtgccacttacaccacctacacttctgcatatcccctcccttttcgagacaagttgaactgatcatgaaggatagagaattttcaaagtgataaagtggagttccagctcttccacattcttcttctttttttttttttttttttttttttgatggagtcttgctctgtcccccaggctggagtgcaatggcgtgatcttggctcactgcaacctctgcctcctgggtttaagcgattctcctgcctcagcctcctgggtagctgagattacaggtgcccgccaccatgcccagctaatttttgtatttttagtaaagatggggtttcaccatattggtcaggctggtctcgaactcctgacctcaggtgatctgcccgcctcagcctcccaaagtgctgggattacaggcatgagccactgtgcccggccacgttcttttctatagtgctttttcattaatttaaaccctgttgggtgtctactataatccaagaaagccttgattttaccacaaacatgtaaattacaaagctttttttttttttgtttaaaacactgagacaaggtctcatctccctgtgttgcccaggctggtcttgaactcttgcgcttaagggatcctcctgcctcagcctcccagagtgctgggattacaggcgtgagccaccatgcccagcccgcagaccttgattggggatctttttttttttttttgaggtggagtctcgctctgtcgcccaggctggagtgccaggctggaatgcaatggtgcgatcttggctcactgcaactgccgcttcccgggttcaagcgattctcctgcctctgccccccaagtagctgggactataggctcgtgccaccatgctcggctaatttttgtattttagtagagacggggtttcgccatgttggccaggctggtcttgaactgctgacttcgtgatccacccaccttggcctcccaaagtgctgggattacaggagtgagccactgcgcctggccggttatggatattttttttacctctactcttatagtcgagcctcagtcttagaggaaaaatagtttctttcagtcgattgccacgttatagtttgctttaaactacttagatttggattcagggtaaagagccttcataaataggaagtgatagaaattcagagggagtgtggcatgtttttgttggatttacttatgctgtgaaacttacctagaagtgtacaggcagtcactaaactatggttaaagaggaatcttttcatttgtacattccttatccctgttacaggttgctgcactttttttttctgtctttatggtagctagaaatatattgtgtatctgattctatgttttcctacatttctacatttgacttggtttgagatcaagtttgtgaattttgattaaatgcctagattatgcatgtgaaaaatcttttgtcctgtgttgctatgagcaacaattgttaaaattaacttttttagaaaatgtggacaaatacatgaatcttaacagatttttaaaaagtcatcatttagcattgtgagtgttctgtctataaaataaattgttactgtgaccataattatcgtggtgaagggaggaatgcagtagaagtgaataatcatcagacacattgacaaaacattcctaaaatgctattcaaatgaggaaagacattatggggctgcagccaagtagccaagcgttgagtccttttagccagttgtctgaccgggtttactattgtgaccaaaaagaagctgtgtgtagtggtttgcatagaagggtcatgatttatctgaaatatctcaactttttttttttttgtaatcctgtctctcatcctcccctgacaacactttacttcattcttaaagactccttttgtcctgatggtgtttgtttcattgctttctaccgtactccagtctgaattttactgactcctagtgattgcttagacttgctatttgattctgttgtgtgatttttgattatactcctttgtgctatttaaactagcagtgtttacctaaattagtggtggtagtgaaggacacaggttggcccatttgaatgaaaatcaggagcattgcactggccctgccgttaagatgaatttccatgaattccctctccagaagggcactaggaatttggctggactacagaagttacttctccagttaaaggcatggagtctgggaatggcttagtttaaggatatatagtgataatgtaattaattctcccactgagaatataggacgaagtgaagagatgccctttgtcctcttcctgcatcctcgcctcttcttcaggtcactattgagaatgaaccctgaagcacttgtcctttacacagttagcaagaagaaaccatgacttgcttcttaaggttttggaagaacctgctgggcgcctcatttcaagacggggtataaagcccctcctcatatttacttctctgtgtaaccatgcactttgcccatgtatgttggaaaacagtgagttttttaaaaacagaagttttaattttaaaaactaaaaatggacttttttttggttaagatgtcagttttaaaaacacagatataacttaggataactccaaaagatattctgagttatgggtgggaacttaaaatgagcacgtagtatattggagatggatattcatttaacccattgagggaagttttttatgtgtaaatcatggaagtctcttagtactacgttcattttctttccacgattttcatttcttctgtggtcagcctttaacccctgagttctttactctgatatacatccatagtgataattatatgattcttaaacagttcattcacagaacttaaatttatttgttattgggttttttaaaaacccacaacggaaatggaaatcatttaaacagctggtttcatcaagacatcagaagggatatcctagccgtagagatgaaaaattacctttacaagtatagaaaggatgttttgctactttatgattaagttaataatttaggaaagctggtatcctttttggccttgtagaggaaaatgaggaatcagttagttggaaaaccagttatttaaacattctcaatgtcagctgcctgaaagggaatgtatataaattttattgaaaaacacctttattcatgttagttaaatcatagcatatagaatgaaatactgtgaattgttaacaaagaaagatgtattagtgcccaaatacaaagatctctactgtgattatgttagggttaaaatgcatgtacacagattgatgctgacgtttatgaactagaaccattttgaacaaggcatctttattagtggctgcttctggggagtaagactgtagactaggggaataacttggagattatggaattactttttgggtcacttgaaatgattatgtgtatactgcactgttttacacatttaatttaaatgaaaattccctttatagagaagaaaatgttcaaatattcaaatttgtacagagaaaaatgcaagcatttgttaaaatcatgatattccctaaatttctgttaatatttaatattatttaattttaccttatctttagttttggggaagttctctttaattttggtataagttggatgtgaacaataaaatacatttatttaattaatggctggtcttgctttgtggcccaggctggagtgcagtggtgccatcatggctgactgacctcctgggctcaggcagttctcctgcattggcctcccaaagtgctgggctcacaggcatgagccaccatgcccagccagaacacattttaaaaagtaacattgtggccaggaggggttgcttacgcctttgatcccagcactttgggaggccggcagatcacttgagcccaggagtttgagaccagcctggacaacatggcgagaccttgtctctacaaaataatacaaaagttagccaggcatggcggtgcgcacctgtagtcccagctacttgggaggctgaggtgggaagtcaaggctgcagtaagctgtgatggtgatcctaccactgcactccatcctgggcaacagatagagacattatctcaaaaaaaaaaaaaaagtaacattgtggaggaaaataattaaattgttgacgtgtaattttctgtgatgattgttgtgctaatagagtttgggtgttcttgatctgaaatgcttgggaccggaagtgtttcagattttggattttttttttttaaattttggaatatttgcattatatacttcccagttgaacatccctaaaccaaaaatccaaaattcataatgctccaatgagcaatttcctttgagtgttatgtcggcattcagaagtttcagattttggagtattttggattttggattttcaaattagggatactcaatctaatagaggtgggtcagaggtatatacatttataattttgatagattgtttcaaattgttctttatggaggttgtaccaatatatattcccagtaacccatgaatttatgcctgttccccacacctttgtcaaacattatatttcaaaatagtttatatttgttatagataagggaaatgcaaattataactacaatgaaatagcatttttcacctattatgagtgaggttggacattttttcacttgttaagaagcttttttttttttttttttgcgacagagtcttgctctgttgcccaggctggagtgcggtggcacgatcttggctcactgcaagcttcgcctcctgggtgcacaccattctcctgcctcagcttcccgagtagctgggactataggcacctgccaccacgcccagctaattttttgtatttttagtagagacgggctttcactgtgttagccaggatggtctcgatctcctggcttcgtgatccgcccgcttccgcctcccaaagtgcagggattacaggcgtgagccaccacgcccagccaagaagcattttttttctgtgaactagatttcatattctttgctctttatttttattggaaagttgctattttattactgatttataaatgttatttatgtattaggcaaattataaaatcagtggggcaagaatggattatttaataaatggtgctggtacaataggccatctgttagtatattaaaaaataaaattcagatccctatgccttcccacacacacaaattagtgcatcgatttatgcctaaaatcaacaaggagatacagattttaagctattagaaaattataggtggatgggtatctgtatttcatagtggattacaataaaattaaaactctgacatgacaaaaggcataaattaaagacaaaaggggaaatgtttgcatataatcagtaaaaaattagtatcctgaatgaataaagatctgtattttattttattttttttgtgacagagtcttactctgttgcccaggctggagtgcaggtgcgatctcagctcactgcagtctccgcctcccaggctcaagcgattctcgtgcctcagcctcctgagtagctgggattacaggcatgcaccaccacccctagctaattttgtgtttttagtagcaatggggttttgccatgttggtcaggctggtcttgaactcctggcctcaagtgatccacccaacttggccccccaaagtgctgggattacaggcatgagccaccgtgcctggccaagatctgtattttaataagtaaatgagaaagaagaaaatggggtaaaagtaacagccagttctcagaagagaacagagtgatcaatgaatatatggaaagatctcagtttcattagaagtaagagaaatgcagagttaaactgcaatgaaagaccatttcatttccatgacatttaccaaaattaataggcctaacaacatcaggtatggagaggatgtagggaaataggaactttcatcattgttgataggagtgtgagttgatattactactaaggagagccgttggcacaatgtatgtcaggttaaacatttgcatcctgttcagctcaggattccatttgtgtatcctagagaaactcttgcatgtatgttcaagtaagttcattgtagcttaatttgtaaacccaaaaaattttgaacaatacaaatgtctgtcaatgggagattgtattaaacaatttttatggtttaattacagagtgctatacagctgttaaaataaatgaacttgaatcttcctacaaataccaacatagacaaatctcagtgacagtgtttagagaaacacagcaagtttcaggtgtgtgtgtgtgtgtgtgtgtgtgtgtgtgtatttcatgtaaaatttaaaaccccacaaaactaaggcatatagcatttatggatatatacataggtggtcaagattttaaaacaggaatgctctaccccagcatcaggatagtggttttctgtggggaaggaagagtgtaagggggtctatcctgaaagatatctacagttctttgttttttaaatctgaaggcaaatatagcataatatcatttcttaaatcttggtgttatagacatacatgtttattggccttcatattttttgacatatattaaatatacattttgaattttccacatgccttttcactatacagagatagtttgtgctttacactattaatatgatgaattttattaataaatttaaatttaaaagatttcctaattttgatatgaagctggattctatttgttaatttttttttaggatttttacgtgaatatttgtgagagtagtctagttttattttcctcctcttttgatgccttgtttaccagattttggttgtaatgttatgctgacttcctaaaaaaattcggaacgttcattcttctccatgttttggaacagtttaagtatcattggaattaaatatgttccttgcagtttggtagaattcagatttatagattatgagatcttgtactttttctgggaaggggttgttcttctagatagccatatagatacccaaacagttcctgttagttatctatttggtagcagataattgtttgggtatctatatggctgattttcttgtcttcaggggtcagtttggtatttacattttcctggaaagaaatcttcagtgttttcaaatttattggacaggataatcctttaatattattttcttttctactgtaactgcaatcgttttcctgttctcatttatagctttatgtatttgtgcttttttcttttttttttcctttctctagttcaggttacctaacctctcagttatttgggtatttttttcttaaagtaaccagctcttggacttattgatacaaatgactctttctaattcggtactttatgcttttgtttttagtttttctttctgctttttctttttttcctttttctcttttttttttttttttgctgggattacaggcatgagccaccatgcccagcttgcagatcttttttttttttgagacggagtcttgctctgttgcctaggctggagtgcagtggcatgatctcggctcactgcaacctccgcctcccggattcaagcagttctcctgcctcagcctcccgagtagctgagattacaggcacgcgccaccatgcccggctaattttttgtattcttagtagagacagggtttcaccatgttggccaggctggtcttgaactcttgaccttgtgatctgcctgctatgttgtgatttcgttatcttgtacttacagttttgaattctttattcagaacttagaatctatggtagctcagactcctccacaaaagcgtggaaatgattaaacacactaaatttttctgatggaatgtgtagccaaagaaatagtcccaagagcaggaagcattcccagtgctcaccattgccagggtgtttggaggggacccggggctatgagggctgcttgtaatgtgtgggaccgatgcaggaataagggctggagttacaggctttccttcagggcttcttcatgcccgcagtgcctcagggatggaagcttttatatcaaataaggcttgtttcctggagtgaagatgcaggtccatcctcgatttttacaggttcaatttgcaagtgactcagttcaagggtatcatgaaatctgcttttgggtgctgtgttcaaattatctgcacatatttctagttatatatgagtgctccctgacatctgtcctgttttgttattgtagctgtcattgcttatagcttatagttattgtaatactttaagtaaattctttatcatttacaaaaatgaatgttaaaaagttttcaaaaatgctatttctagtgaaaaacatgaggattcctttgcttcaattaaatgtttgtttgatttaagccagttgtgtacgtgttccgttgtgagagaaaatgaaaaagatttagtttggtattgcattgtgtaatactgggtctaaagttttataatattgtctagtcttcttgctcctgccagtccccatataacattaagccctttgaaaacttttcatactcaacttagtatgcctttttaggaattgttttaatatcgaagtagaaaactccgtacagtctttgagtttacttgagtctgtaggtgttttatttatcttcggtgttccagaagaattcatgctcattcccatgttcctctctccatgttagaagggagaaaacatccctcattcccagctgcatggcactgaaggcctttaggactgtttaatgaacacacacagttggtgaaatgagaaggattggccttgttcatgtccacggctggactagggtgaggcaaagcatctcactaaggaaaggcccagggtgcagaatttaaggaggcacttgctctgccatgcatgtagatgcaaggtcagcatggcataacccttagaacaagtgccccttaaatgttgtgccttaggaccctggctcgcctcaccctggtcctggcccagttcagttcctccatgtgtccattctttcctccttctgcagactctctctgagcctgtttattctcaaagtaactaggaaaccactgccttgttcattggggtattcagataaattttgtccactgctgacagaactgggtgagaacaagttattattatggattgtttgagaggtaatgtcagtgtttctcttcctggattgcgtatttaaagacagtcttgctactgagagcttgttgctaaagccagtcctctgggatcctgttatgccagagaaggttatcagatgcaatgacatcctggttctcaactcagcaggcatcatggggcttctcaaatatctagtacttgcccctaaatatgtcttgggtgataggtatgtgttctttctatccactgttgtcatttttgtggcaaataacactagggggttcttaggaataggagaggactgttgtagatcaagtggcagcagagtttccttagcactttccaaaacctacatattttactttcaggtcaaaggatagattagtttttacatcaaacctagtagagtgaatatgaagaaggaaaactgtgatttggaaagtcttctatggcctatgtatgcacacacactggtttattttattttattttatttatttatttttttgagacagggtcttgctctgtcacctaggctggaatcatggctcactgcagcctccacctcctggctcaagtgatctttctgcctcagcctcctgagtaactgggactacaggtgcaagccaccatgcccagctaattttttttttttttttttttaaagagagatagagtctcactgtattgcccagactggtctcaaactcctgggctcaaggaatccacccacctcagcctcccaaagtgctgggattataggcataagccaccatgcctagccaggaaagagaccttttgatgaagaaagggtcaaagtcatgagaattacaaatgtcactggaaagcagaattggtttgcaaaggaaaggagaagagtttgaccttgagcatgttaaataataagaaaatatatttctgatgattcaaagattaaacgtataaaattattccttaaggaaagcaagaagaaaaatagatgaataatcttcaaatagagaaggcctttcgaggcattatataaaacccagaagcataaaagactgggaaatttgattaataaaaattcatgttcatgccacaacacagatggacctcaaggacattatactaagtgaaataagcccgacaggaagaaaaatattgcttgatatcacttatatgtggaatctttaaaaacaaaaagtcaaatatatatatggagaatgaaacagtggttatcaaggatgaactaggggctagcaagtggagagatgtaggttcaaggatacaaagtagcagatagggaggatgagcaagtctagagacctaatatacaacatgaggcctacagttaattatagtgcattatatttgggatttttgctaaatgagtagattgtagcttctcttgcccccaccaaaaaggggggaataactatgcaagataatagatgtgttcatatgcttcaccatattaatcattttactatctatattatataccttaaatgtgtacaatacaattttttaattgaaaacatgaaactataaaaatccataaaatctaaattgaaaacatatatatgtaacacattacaaagggccaactgtcctaattatataagagctttttacagatcataagatgcatccaatttaaatgtaagagacattttccaaggaaactatgagaacaatccaatctaataaagaaatgtacattataattatactaagtgaaataagtatagggtcttgggactaggagttcaagaccaacctgggcaacatagtgagaccccatctctgaaaaaaaaaaaaaaaggccaggtgcagtggctcatgcctgtaatcccagcactttgggaggctgaggcaggcagatcacaaggtcaggagttcgagaccagcctggccaatatggtgaaaccccctctctactaaaaatacaaatattagccgagtgtggtggcactcacctgtagtgccagctagtcaggaggctgaggcagaagaattgcttgaacttggaaggcagaggttacagtgagccaagaccgtgccattgcactccagcctgggcgacagagcgagactgtctcaaagaaaaaaaaaagaagaagacaaaaattagccaggtgtggtggcacatgcctgtagtctcagctactcaagagtttaaggtggggaggattgcttgagcccaggaagtggaggctacagtgagttgtgattgtgccactgcatactagcctgggcaacagagcaagatcctgtcttaaaaagatcaaaatgtgtctttttgtggctcttcctataagacaacctccttgttcttcaccttcatcatttactttctacttgttttttgattgtgtcttccaaccccttaaaaatgggtgtttttcagaattctaggtaggtaggggccatttatcttgctacagttgtataatcagggccagcgcaatgcttgacatatgtgagaagctgtatttattgaatgaatggatgaatgtacctctgtccttgtcctccaactgttttcaggattttctacattggcattcagatgttgcctccaaaataatgtgtcccagaacaatctcatgcagtagatgtagtgtatctgaacaaggtatttataacattcttatgaagaacacagtgaaatatagacttactagctttttagttaggcatactagtaattgagtgatttattatataagtactgtattgcctggtggacatataaagggaaaggacttaagagttttaattgattatttggctcaacataagcaaagagtgtgacctgatttttgaaaatgctaaggtgatttcatatgatcagaagaataagttttgctttttactatgacactatacctggaatattgcatttgatttagggatagcagttacttggagttcatttagagctaacggcttaaagaatggtgaagggactggaaattatgtcacaggaggaacggctggtggaaaggtgaatagttagcttgaaggagagaatgtttttgggggaggggtatctcttatgactggatgatgatataatttattgttcaaaccagggctctttgagactgaaggtcatcactatctatacttatcctgggatgatgggcgtggactaggactgtcttagcaaatggaaacatggttacctacttatctccaaatattttaaggtctgtcttgtgaaagaaagatcagacctcatttatgggagatttaggaccagtggacacaactacaagaagacctgcatctttttccttataacaagccataatccaattcttcagttgttgaagaatgtaagggctgccttatgaagtggtatgtttcttatcactgttgatgccaagaatctgtacagttgttctttctaagtcttgataatgtacaggttagatgaatcgatttgtaccaacccatcaaatgtttgggtattttattcttttcaggtactatgcagatgtccatgtacttattacatttagtttaatcatttggatatttctggccttttactagggaaagttagaatccatgtctttgatggcttttgtgatagctctatgtctgcagtcatgtgatcacttacaccagctgcacaacttgtccattttatcttacagcacagctccctcttttctcttcagcagagtgcagggctgttgtgttttctgtctctggcctttttctctactttcagcacctgcccttgttttgcctggaaatgtaagcgtatgctcttatttggtataacactcttctttattcctaagtatcttttttttttttttttgagacagtcttgctctgtcgcccagggtggaatgcagtggcatgatcttggctcactgcaagctctgcctcctgggttcacgccattctcctgcctcagccttccaagtagctgggactacaggcgcccgccaccacgccctgctaattttttgtatttttagtagagacggggtttcatcgtgttagccaggatggtcttgatctcctgacctcatgatctacctgcctcggcctcccagtgctgggattacaggcgtgagccagcgctcccagccattcctaagtatctttaaaattaaaaaaaaaattatgtgtggctgggtttttatgctaaacaaaaggtgtttattgtgatcttcatggcagagtagttaaagggatgcaaactttggatgtgttcagtttgtactgtgagtgctgtggtctttccttggctttccacagggcactgattatgtacttgattctttggtaccttatttagtccttgacagcaactctaagaggtagacgtgactatttccattttttaaagaggtttagaaaggttaaataatctgtctgaggtgacctagccaggaggtatcttagctggatctgagcccagtttcttcatttgtccacgtatttattcattcagccactgtctgagtgcttgcattgtgccaggcatcatgccaggtcctgtctgcttctctggatttgtacctaacaagtcaccttcttctttccctgcaaatacacactctagtcacattgggcattctcctctacctcctgaaaaaagactcaaaatgtactatttaaatgttaaatctcatccgaaaagtactttcacagcaacatctagactagtgtttgatcaaatatccgggtactgtgtcctagccagtttgacacataaagtgaactatcactgcaatcaagacagtgtggtatttgtgaaagttagatatagatcagtgagacataataaaaaatccggaggtagacccacacaattgtggacatttgattttcaaaaaagctcaaatgctgtttaatgaagaaaagttactctttttaacaaatggtattggccatctatatgcagaaaacaaactcccgtgtaaacttcacatcttacacggaaattaactcaaagctgatcatagatataaatgtaaaatataaaattataattttataaatttataattttataaattttagaaaatacatcagaaaaaatcttcatgactttctgttgggcaaagagttcttagacatgataccaaagcatgattcatgaaagaaaaaatggtaatttagacttcatcaaaattaaatacttctgtggatgatgccgctaagaaaacgaggttgaatatatttttgtatgtttataggccattcgtttaccttttctttgaaattcctagatggggtttttgttttttcttgattgttcatcttcttattggtttgttaatcttttattgattgttacaagttccttaagtattttagaagcaaatctttgttctatgtgctacaaatatcttcttctacttaattgcttgttttttaactgtctttgtggagttttggataaatggcagttccaaagttagtatagtcagatttgtccatcttctttctcatttgtgcttgcgcattttgttttttgttcatcctgaggtcataatatgttatactacatgaactttgcaaagctttagagatttgtctttatatttgggtcttcaaatcactaggatttgatttttgagtatgggttataggatgagaccaatttcatttttttctcctgtatgtctaacttgtcatcacagctctgtgtattgaaaggtccagccttttcacactgagcagctatgatgcctcttccacaccagtttcttctataaatcaagtctccaagtttgtgtgggtctatttttgtgttgcagttcagttcctttagttcttttatttatttcttttgccaatatcatgttgtcttcaatattatagttttataatattgataacaaatcttgatatttggtagggaaagtctcccagattatatatgtgaagacagtgatatcatttacaaataatgacactcttgttgttccttgcttatccttaatccttttattttgttttcctgccattcagtactagctcagactcccagtacagtgttgaattgaagtagtaataatgagcatctttgtcttgttctaaatcctacagggagtactttcaatgtaaatagatattttgtagacacccattatcaggttaaggaagttcccttctgttcctagcttgctaagaggtttcttttttttaatatacgggtgttgaattttataaaaagattttctgtttcttttttttttttttgagacggagtctcgctctgtcgcccaggctggagtgctgtggcgcgatctcagctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgccctcctcagcctcccaaagtgctgggattacaggcgtgagccaccgcgcccggccgattttctgtttcttttgaggtaatcaaatgatttttttttctgtgaatagtagaagttatattaaatacattaatttatattctaacatcaagccaactttacattcttggaattaaccaaaatttgtcacaaatgattgttattattattgcacttgctaggatttgacttatcaatactttattattagcccctgttcccaaatttaaaatgggtccctatttcagggatattaagttttcttttctttcttttctttttcccttccctttttttccttttcttttcccttcccttttttccttttctttttccttccctcttcccttacctttttccttccttcttcccttccctttttccttccctttttttcttttctttctttcttttttttcttttttttttttttttgaccaggtcttgctctgttgcccaggctggagctagagcacagtgatgtgatcctggcttactacagccttcaacttctgggctcaagcctttgtccagtctctgcctcccaagaggctgggactataggagcacacccccttgcctgcctgttttcttttttcaaatgactgatgataattataggatgccatagattaagatgtattctggttttagagatttaaaaatgtatgtcttaatgccagttaagtgttctgatttttttttgttttatatctatgttctcaggtgagcttggtttacaattttactttctcatgcttttcttttactttttctttttgagacggagccttgccctgtcgcccaggctggagtgcaatggtgcgatttcagctcactgcaacctctgccttccaggttcaaatgattctcctgcctcagcctcccgagtaactaggattacagatgcccaccaccacgcccagctaatttttgtatttttagtagagacggggtttcaccgtgttggccaggctggtcttgaactcctcacctcgtgatctgcccaccttggcctcccaaagtgctgggattacaggcgtgagccaccatgccccgccttctcatgtttttcttgtcaagttttggcattaagattatgcaccatgatgaaatgaattgagaaacgtgcccacattttctagactctggaattgttggtgtaatatttatttcttgactggttgaacaagcccataaaagcatatggttgtggcattttaactactgatagtttctttattgcttacaaaactattcaggttttctatttcttcttgattctgtttttttcagtttcattttttaaaggaatttgttcatttcatccctatgtccgaatttgttagcataaagtaactcataataaattcatgtatgattaatctatataacatctgttgtctctcttgcttttttttgtagttctttttgtttgcttttgttagatgttagttttattattctttcaaagaactaagttttgacactgacattgttcatcttttttatagtttgcattctgtttcattattttctgtgcctattattaatatttctgtacttctactttgggttgattttactattttttttttttgaacctcttaaaagggatgcttagcatagtagatggtcttttctctttaaaagttatgcttattagataataaacctaagtacattgtgctttacttgaatctcatgtttttatatgtggagttttattatttagttttacaaagtttgtaattgttatttcattttcttttacccctaactatttagaagtaccattctggctttacagacaactgttctgtatatatgcatcagatcacacttgttaattttattgctcaggtgttttatcttgttgcctcttgtttgtttcatctctctcaccatgaattctagtttgtgaattttttcacataattctcatgatttttgctttatatgataatttgttagtaggtacgtgcaaacttagaactatgacatcttgctgaattgtcccttttattgttatgtaataacttttatttctaaaatgcttttgccttaaaatctattgtttctattattaatataactacactaacttttagttagtaatttccttattttccttgtttagatgtgtcttttgaacatgatatatttaaattaaaaaaatctagtccgatatgatctttatttttttttttttaaattcgagagagtcttgctctgttgcccaggctggagtgcagtggcacgatcttggctcactgcagcctccacctcctgggttcaagcgattctcctgcctcagctcccgagtagctgggactacaggcgtgtgccaccacatttttttgtatttttagtagagatggggtttcaccatgttggctagactcgaactcctgacctcaggtgatccacccacctagacctcccaaagtgctgggattaccggagtgagcgaccccgcctggctgatctttatcttttaactggactacttagtttacatttattgtaattattactgtgttcatatatgtttctactgtgttattttgtactttttgtttcccctgccttttcttcctatttagttgattgattagtttttctctctactagcttagaggtttgctttttttttggtggctaccctacaaatgatgaggttcatatttacttttttctgattctattaataattagtatctttatcttcttttaggacaagtcgagaaccttgtagtacttaaagtatcctttcccaatttatatgctacttttgttcagtactttaattatatatatatatatagatacacatgtagaaagagtacatgagagagagaggacaaaagagcattaatgttttatgtagtatgtttgtttaattcacttccgtaccactttcttgttcttcataccttcttgcaactcaaacctaccagctgggatcactttctttcctcagtgcataccttttcaagtgtcttttgtcaaagatctgctggttgcacgctcaatttttcttggaaaatgtcttcatttcattatcatttttgacagattttttgctaaatattgagttataggctgacagttattttctcacagtacactgttgatacaattccactgtctttaggcttttatttttggttttttaaaatcagctaacagtatgttattcctttaaatgagttttctattctcttttcttttcttttcttttcttctcttccccttttattttttgagaccaggtctcactctgtttaaaacattttcttgttatctgtggtgttcctcaatttctctttgatgtgtgtaggtatgggtatagattgctttctattgatgcttcttgagatccactaggcctcttgaatctgtagataggtgttctttttatgaattctagaaaggctttacatagtatctctttacatattgcctctctcccattctctctttcttctttatggagctctatttagaaaaatgttacttactctatggtctatacctctttcatatttttcatttctttgtcttttggggcttccttttggatagttacttcagttgcgactttcacttcacaaattctgtctttgattgtgtctaatctgctgtgaaacttcttatttgaatttttaattttagttatatcttatttctgggagatctcattggttcattttcaaatctggtcattctttattcatttttaagactttcctggaaacatagtacgcatgcttattttagggcctgtgcttggtaattcttacacagtcacactttgcttaacgatggggatacgttccgagaaatgtgttattaggcagtttcgtcattgtgtgaacatcatagagcaagcttatccaacccgtggcctgcgaaccgcatgttgcccaggacagctttgaatgcagcccaacacaaattcgtaaactatcttaaaacattatgagatatttttgcaaaatttttttaaagctcatcagctattgttagtatattttatgtatggtccaggatagttcttcttcttccagtgtggcccagggaaaccaaaagattggatactgctgtcatagagtgtacttacacaaacctagatgttatagcctattaggcctatacctaaaacctaggcgatatggtggtgcctattcctcctaggttacaaatcagtacagcatgtgattgtactgaatactgtaggcagttgtaacacaatggtaagtatttgtgtatcaacatatctaaacatagaaaaagtactgtttagggcccttaacatgaatggagcttgcaggacttccaggaagttgcactgagcgagtcagtggcgagtgactgtggaggccttcaacattactgtacactactgtaccctttataaacactgcacacttaggctacattacattacatttattaaaaaatttttcttcagtaatcaatgctaacttactgtaacattttgactttaaaactttaattttattgaactttttgactttttttaaataacagcctaaaacacacacacattgtacacctgttcaaaaatatcttttctttgtgtccttgttctataagcttttttgttttaaaatatttatttattttttctttttaaactttttttgttaacagctcaaacaaacacacacattagcctaggcctgcatagggtcaggaccatcaagatattcctaggtgataggcatttctcagcttctttggaatttttttttttttgagatggagtctcactgttgcccaggctggagtgcagtggcacgatcttggctcaccgtaaccttgacctctctggttcaaacaatcctcccacttcaggctcctaaatagctgggactgtagatgcgcaccaccatacctgattaatttttgtattttttgtaaggacaagattttgccatgttgcccaggcttgtctcgaactcctggactcaagcagtctgcctgcctcggcctcccaaaatgctgggtttacaggtgtgagccaccgtgcctggcctatagtcttatggaaccaaaatgtcattgtgtagtacatgactgtacttgacttttcgttgttactgtgtgataacgcagacttgtttcttttgattcttgttcttgatacctttgtttccttgtatgtttagtgatttttgactgtgagctaagttacttatttttaatagaactttgtatgtattgatcctttgaggcctggcaaaagatgggttctttcagaaagggtttatatttactttttctaggtgctgaggggctctgccagtctggaatcacctaaattcctatctttgcttcgttttagccaccacatagggtaaaattgggctgtaaaacctatctggaagttgtattgattttatgaattcttgggggaggtgggcttcaccctccccctataacctttgggctggagtttcggacaggctctttctttttgcagtcttctggggttctgggatggatgtgagtattactttaccattataagaggatctagtctctttggcatctgaacttaatggtagggttttgcttagtttcctcactttggtcaaactcttgagtgtggttgtagatcctaattaggaaaactcatgcttagctcaggggtttggacattgtggtctgcagaccaagtctggcctggtgttttctttttgtaaataaagttttaatggaacacaacaacatccattcttttatgtgttatctatggctgcttttgtacttcagtggcagagtggagtggtttccgcaggagaccatatggtctgcaaagctgaacatatttatcgtatggtcctttatataaaactttgctgactcctgcgcaaagtcattaacctgatggacaccctatctaattaggtgaaagtctcctttagggccccatttccttttctggctactgctttccttcagttcctggcctgaacattctttattttctcgctagctcatggacaaaggcaagttttttgtttttttgttttttaagtaacacatttagttgtcttaagcaggattgttggtctggcatctagtccttcatgtggctggaaatacgtatgtatttttataacacggccccagtgatgtattgtcaggcttgggatgtactacaggtaacagctggataggtgagtttgcagagaatgctatcacatgtactctgcatcttgaattctagtcaaacttacagaagatgtgggaattggaagagtggcagtcgattgtagtggaggtttgtatcagtaacatattactgattctgtctcttagcagccaagaaatctaggagggaccagctgctttgtagccccagactgcaggatcacagtggtaactcttttgcctccttcctttaatcaaggttcagttgggagtcaggagctagaagctggaaatccagccattgttcccatttggatggggtaagcggaatgaggacagtcacttccttggtgatctcatctaatcgtaggtttaaattctacctctgtatgctcagaaatctccagttcacattgctggcctaaacttcagactctataatggcctacttgacaggtctactttgatgtctagtgggccccctcatccaaaacatgtccaaaaatgaactccccatctgtcccccacatttggctctttcttttccatctcagtaaatgtcaacagcattccaccagtagatcaggccaaaaaccttacagtcattgtgtacttctttttttcctcttgccatttgccaaggtccatgagcaaccacaaagaacagagcccactcttgacagatgatgaatatgatagtgtgagtgagaaataaactttgctgtttgagatcttaaacttgtttgtggtcctagaataaccaggcctatcctaactgatacagtttattatgctgtaagtacacacacatatgcattcacccgtgccgccctacccccgtcatctgccaccatataacgttagttctcagagcagggaattggtttttgtttttgtttttgttttaaattgagacagagtctcattctgtttccgaggctggagtgcagtggtgtgatctcagctcactgcaacctccatctcccgggtgcaagcaatcctcctgcttcagcctcccgagtaggtgggatcataggtgcacacctcgacgcccggccaatttcgtatttttagtagagacagggtttcaccatgttggccaagctggtctcgaactcctgacctcaggtaatctgcctgcctctgccttacaaagtcctgggattataggcgtgagccactgctcccagcctgggaatttgttttgtttactgctgcatcgctggtatgtataggtgctcaataaatacttgtaaatgaatgaatgaatgtgtactgtgttgtagggattgagaactgttcaggaatgtacagtggggaggaagatagatgtttaacaaatattactctaaaacagtgagtacattgtaaactgtgaccttggtggtccaacgtatatctgaatcatgtgggctcccgattaagagtggagattcctgtggtgccttgcccgagacctactaagtcaggatttctagatgtggggcctgggaatcttccttttcaagcagttattgcaatgattctttcatacacaagatttgagaccactgcttcaaggggagagtggtctggtgctgccaatagataaagacaaagcagatttgcccttgtgttgttaatgggaagatactgactcacgtgggagtcatgagtataaactattagaacttttcagtactttaaagaatatattgggtttagcaagtattttttttactgtatataaagaagcattatttttaataagcagaattacagttttactgctagatcaaattattaataagaccttggaagaacagcatggaaaaggaaaaattcatttaccttcttgacttgtgcccactctactaattttatagtttttataataaaagccacagcctttactgaatttttactctaggccagacactcaattaagagcatagactctagagtgagactgcctgatttccaccaatctgcttaataactatgtaacctctctgtgcttcagtttcctgaaatgagggtactagtcatgcccactgcatagtattattttgggagtaaaattggataattgtgctctgaataagtgtagcacagggtgagaaaaattcgtgggaaaccacaggaagtaccgaacagccagaagaatgagctgaaggatttcaaggctgttaaggagcatctgatttctattctccaggtattagtcagctcaggctgccataacaaaataccactgactgaatggcttaaacaacagaagctgattttttcacagttttgaagtccaaggttaaggtgtcagcagattaggtttgggtgaaggctctcttcctggcttgcagagactgccttcttgctgtgtccccacatggcctttctcaccatgtgtgtgtgcttgggaaggggagagcgtcagttctcccttgtctctttataagaacatcaattctatgagatcaaagccctgatcttatgacctcatttatccttaaatacctcctaaagaccctgtctccagatatattcacattgggaattaggcttcaacgtatacatttgtgggaccataattcagcccacagcaccctactaccaccccaggaggcaaatatatagcatcctctaagccgagatgatttctctagtatcttctaatgagtgtcagttaaaaattattaccaagtggctagattcacctttgtatcaccaaaatacttatttcaaagtatttgccatttctgtaggtgccggtgtgttgcaaaaataaggtacaaacaccctgggagtcagtctttctgtatactgagaggtgtatcattatgtagatatacagttctgatatcttcatgaattatacatgacagctttatgttattttacatttctaactaaatagatattatctaatactcatttaacaaatgtctgtttgtcctgctgtatgctaggcactgcttgtagccatgaatactacagcaaaaagcttagcagagacaaggctctgccttcatggcatatagactatagcaggggacatgtgtttagtaagtaacagacaaagaaatacatagcacaatgtctatgtgctgtgaagaaaacacagaaagctatggtaattgttgaggaaagcagtttggtgggttggagtgctattttagaaaagtgataggagagcatgggcattcgtcagggaaatatttgagaaaagaacattttctggacagagggatgaaataccaaatacagaggccccatacctgggatattcttgacaagtagtataagggtgacaccccctggttctggggttatattgcctggaaatgctcaataaatgttaaatattgctgttattaatgtgaataaggtccagatttaactgcaatacacattttcctgtctgtcccaaatatgcttttttgtttgaggctaagttgttacagggattaggttgccacccctccccttttaaaatcaagataactgttaaaatttctgagtcagttttcagtttatgcacactaatggagtaatgggttgctgagttttcaacccaagtacagtactcttaatggaaagaaggttgaccccgacaaagagagtgtgtataggtccttccaaaaagaacacttctttgtaatcttttcgttttcttctaaagcttcatgccagttttgtattcttttagagaatatatttgtgcctattttaatattggaataatgtttcaaatggtggtttggggagctgtgtcgtgtctgtcttgtggatttgaatacccttgcccccaggcacactcctggcttgcaccagtatgagaagccctggactagagccatgtggcgtatgttctggcttacattcagcagcaggctaatgttacccaagggcattagggtgtgggctgggtggttttactgttcagtatcctgtaaagcaaaacacaaatgttcaacttccttccataaattatatataaaataaaaaccacgaaaatgctgttttcttcccagaatgagcaatatgaagtgaagcatgagaaaatccaatctcctgtcagaaatgaacagtgaaattcatcattctgtcactgtcagaagagaatcaccagatagaaggtgtagcaacaagcactgtccccacaccatgtttatttggctttggaattcataatgagacactcatttttgcagactaattttctttttaaattatgttttattgaaataatattaaaattaacttagcagtttctgagtatttatcaataatgggtgtaggtgactcaagcatggccttgggtcagaagaaagccaaactctttgacattttgccagaaaaaaaactgcatcagtgatggcgtcgatgtggcccctgtactcttgatttgcattccagtcatggcatctgctttctcatactccttctcaacagcttctgcagtaagtcattactaattgatgagaattgccaagagatgaaactcatttgtcaactctgtcctgttaagtatagatgaaccctgtttggataattagaaacgtgctataaagtagtgaacatttttaaagtttcatgtgtttttaataatatacaaacattttttggctgggcatggtgactcatgcctgtaatcccagcactttgggaggctgaggagggtggatcgcttgagctcacaagttcaaatccagcctgggcaatatggcaaaccccatgtctacaaaaaatgcaaaaatttagctgggcatggtggtgtgagcctgtggtcccagctacttgggaggctgaggtgggaggatcgcttgagcccaggaggcagaggttgcagtgagccgagattgtgctactatactctagcctgggcaacagagatagaccctgtctcacctcctccccgcaaaaaaaaaaatacacacaaacattttaaggcaagaattatgttaagttttacttctagaatattaagtgaaatatatttaaagcttttactaaaattgaaggtggtacgtattttaagtgatgactttgtatggtttgatattccagaatgaactcttttctaacagaaaggccaaactactagtgaatatgaaattaagataacagatacagagaaataaagaaggaaattataataaactcttctgagtatcttcaggtatatgtatttcagaagcctgtttaaatgggaacagttgatatgtcacttgcatttcttcagaacttctgaatgatttgtgtctcccatttgaattacctagtatttgaaaaataatcaagttagtttcttttaaatggtgagttgattttattagtttttcattagtctgaatcggggagcttttgctttgctgtttgttgtatctgtgttgaaaggaagtggttgcagagataatgtaagattatagtttggtgaaatgtcaccatttgacatgaataaataataattgctcactctgaaactttaaaaaaactgcatttttttttatttaaaaaaaactttagtgtcctattttggaatttcaattgcaggttgaaaaaaattacaaatttagagactatagtgctaagagattagtactaaaatgtactatggtgaagaaaactgcttggcatttcataattgtggagcattgctaaatcgttattttgaagattaaaattaatatttgaaagtaataattaagtccatggctgccaggactaattgaaatttttgtagcgagaaaatatatgatcccaaatgccattacttattcgcgatgtcttactaataagaggttctgggttcagtagttttcatactcattgtttataacagacaagatttgtttaatgatgtttatcatatacagaacgctgttcattctacatacacgttgcattctaattagaagataatgtcgtaagcaaacattattacttttaactattgggaaaaagtgtcatggcaacatctagggcattcttaaatccactgtgcttttcttgcttttcttagtccttgttagatttggttttgtttagctgtcaaagtctgacagaaatcacaacctaagggagtatagccgtaggcgagatgctgtgctcatagaattcccggtgcttctttagagtggtttgataccctgtagttagagagaaggcgttatcaatttagcaactgcagttgggaagtagcatggcctatggttgaggctatggttttaattttggcactgtagattactgactttgtagccctgtggcaagtttctttgcctcttgccctcatagggttgttaaagaggttaaatgtgtgtcatttgtaacatttagaataacaactgcctcatagtaagtgaatataaatggcatttaaaaagaatattcctggcaatatttattttcgagctatttgaaagtatatttagaaggattattttttttattgttaaaaagatgatagaacaacagtattaaagaagagtttaaaaatagttatccatattatcaatattttaaaataatgtttgtttgcttaatatcttgtaatttcaatttacctgcatgcatattttatgtaactgagatcataattacatagcaagcttgctagggaatgggttgggcatagtggtcacaatatagccacatgggagagggcagagcagtctttcctcagagagaaggagtgctaagcagctggagcaacttcttcaggaagttaaatgcataaggaagaagaactgttttccccttccaaaactgacagacttaaaaacatcagtatataagcactcttgcatagcagtagtgagactgtaaattgaatatttccagagccaatagcagagaaacagaacagttgtttgatctgaacttaactaaaaggataatctcggattgatgtttttatgtatcatgaaatcttcttctgtaaccctagttttcctgtgtagtttatggggcatgcctgccttcatctcttatacttgtttgagatcattactctgacttccctgtcagagatactacaattccttaagttttgaagtttggttgattaatgtgtctacttgaaggatttattatgacacatgtagaataaactccttagttgggtatctcatatcgatggtaggaaggtctgagtaacagcttttgcttatcctggctccaccattggagaagttgagctgacttatcttttggaggcagttgcaaaaattcattgccagaatggtggtcccagtcctttctccctccaggtctgagggctcatgccaagtggggttctgattgaactagtgagcatgtattagtagaggccagcctcttgaagccaaacagattggaccatgatttcattttcatcgtcggctttaggtgttggtagaactggactttgagagggcactattccagagaaaaaaaagaaggaggaatatggatcactaggacctgaagatcagttgctctctctctagatgagggccgtagggggtggattcagttatggtaaacagaacagctagttttttaaaaacatttcttatttgacttgttggaaaagctttgacaatgagatgtatgaaattcagagtttgggggagttctttcatgcccaggtaccataggtttgcagcttgatgtttggaacttccttttctgggacagggtggggaaggatcacaggaattgagtgtgcacaggctggcctgctcatgtgcgcagcgtacagcctgggtggacactaagcccttttagatgtctgtctgtatgacagggtggggctggggctggggaatgtgacaatgacaacgttgtcagcacgaaaagactctgccaggaaggttagaaaccagttgtggtctgagaaatgagttggtgaagccaaaagtgaaatctgcacagctgggcagttgaaggatctggagtgaccaacagagaaggagacaggtaagcaaggatcagaaaatgggatccttagtcaatcatgggagggtactgcatagatctattttgtttttcaagatcagtggctctccaactttaatgttctcgagaaacacttggaaacacttggaaagcttgttaaaatagtttcctatactcatcttcagagatttggatttatagggttgagctgaggcccaagccatgaacaagctcacaggtgatgtcaatgctgctggtcctgggaccacaattctgtgtttacactgtatcacaggcaaacttttcttactcctccagtctcaacttttctgaaaagagaaggaaataggaacttttgagttcttgttctatcccagatgcttatatatatgtatagcatcatttacttctcacagacataaaagtcatactatctctattttctatgaggctgtggcggctcagagaagctaagtaatttgcccaaagctacacagctagtctgtgttatgactggttttttgagttaatgccaaatccttattgtaactcttagattattttctctacaagtcgctgcacaacagggtgaagctttaggcagtggagggagacttcccttcagtcatgggtgagaagcactcagatcactctgttgttattgtagatttctgtattcaccaggatctaaaacgtgacagttacaccaagtgaatttcagagatctgtcactggtaaaaccccttcagctttttgcttaaaaatgtcataaaagagaatattgaaaaataatgaaattttaaaagcttaggatcaagctgaaatgttacagaactttctggcctttttcatttaggatttcagttttaattttgttatgagagattttgagtgatgttaaaacaaaggattgtctgcattatttaagttctgtgttttgaaatgccataaagacaaaacataaaagcatatcaaggcagatagaagaacaataaggtaaaacatgtttttctctggtaaggtatatatttgcacatgctaacatactttgttctgtttcattgttcaaaatgaatggcaacagcctttataaaataaatacttagagtgattgtactgaataatccttttgttttgagtagttaaaaaaaaagcaggttataagaaatcttagaactctgtgaaattccagctctgctgtgaaatgatctcattaaagccaaccttatactctgctttacctcccgagtacaaaagatacatgtagcgtgtgaggttgtggcctctcacagtaccttaggaacgcacgttttccccttcatggacaaatacctgacttggcaaaactgagtttttttgggatataaagtactaatgaaaaatactgcttaaaagaaactatccaaggtttcatctggtgatgatattattccttatttatatcattgctgatgaatagtgaattttagtaaacttggtctaggaagcttgtttaaccttatttaaattagatgtgaatcttagattttaactaagtaaatgtatttaagattattctactgcttgtatgtcctcctccccattttaatataatgtaaagaacattgatatccatctctgattttcttgttaagctatcttaatgtttactgaattctatgagtatgttccctgctgccttccccatttctctgcttaaatcagaaatggctttcctcctctccaaaggtggcactatataaatgacataaataggctcaggatttcagaaaatgattgtatgtcttcgcttctttctagatatctttgttgtagctctcagctcataagataatgatctgtgttcctatgcaacttctgttcccaaatttgagctccttgcagcaaggactttcctattcaactaggaatttctagaagaaactgcttctttcctgtgccagggtgtcccgaatgagttagaaaaagcatttagtgtagatgagcaattaggaatggacccagccgggcacagtagctcatgcctgcaatcctgaggcaggaggattggtttaggccagaattttgactttttaaagtatcaaatccaaattttttttttttcgtaattggagtagtggtagtagggaagggccttatttactgatgctcaaagtgcctcagtacatacttagcttaatggataatctggaattacctttagaatctcactcatctaagtcttttttttattgtaaaaaataaaacctatagaaatccacagaagacaaagtagtatggctttaatgaattgtcataaagcgaataccctcctaacaccaaccagaacactagaactttgccagccaccccagaagccttttacagtccccttctcataaaagtaattatcctgacctttatggcaatcatttccttgcttttctttaggaatacatgcttgggtgacaaaatgacaaatatcataggtggttgtttcttttgaaaaacaaatctttggccgggcgcggtggctcacgcctgtaatcccagcactttgggaggccgaggtgggcagatcacctgaggttgggagtttgagaccagcctgaccaacatggagaaaccccatctctactgaaaatacaaaattagccaggtgtggtggtgtatgcctgtaatcccagctactcaggaggctgaggcaggagaatcgcttgaacctgggaggcggaggttgcggtgagccaagatcgcgccattgcactccagcctgggcaacaagagtgaaactctgtctaaaaaaaaaaaaaaatctttaagtatttttttaatctatagcttctctctttttttttttttttggctgatagaatccccattgtgcaagtttgtatttcttgtaaattgatagtggatctagagatttgctcacattcagaatatatgtatatgaacatttcgaaagcacacagtgtctgagatgttagcagccgttgatatctactgtctagatccgtgaattaatatggggttgcaaaacaatgatctcattcagtcatttctttttcatttgtttgctcaaacatttctataaactggggtttctcttcatctgcttctttgttacccagtagtatagggtacccaggaggcttctgggttgctgggatttactagctatggggttctcctgggacctctttgaggttgagaaactgaacatacctagaaagggccatttgataggcataggtccagtgacagtgtcttggttcttaggttggacagggagtgagaggtcctggcctgcaagcctgttgctgccattgagtacttcagaagaatggactctgtacctgtccatttcagctgcccagtttttggatctattcctgtttgttgacagatttaaaaccttattttgctatatgaaactactaaatatcatctggtcctatcgcttgccattagtagtttaagagatttcaataggtgaagagatttccatcttacagagagttcaaggtcatcagaggccaagttcatagattttaatctcaaaatcaaagtctgagttagatttgcatcttaaacagagttcaaggtcatcacagaagccaagttcatcaattttaatctcaaaatcagagttttacattgtacgttgatgtcattatatagtattaggtttgttttttaaaaaaagattttaaaaactaaactttttaaaattattatactttaagttctggggtacatgtgcacaacatgcagggttgtgtgctgtgttggtttgctgcgcccattaactcgtcatttacattaagtatttctcctaatgctatccctcccccatctccccaccccacaacaggccccagtgtgtgatgttccctgccctgtgtccaagtgttctcattgttcaattcccacctatgagtgagaacatgcagtgtttggttttctgtccttgcgaaaaccaaactagtttgctcagaatgatggtttccagcttcatccgtgtcgctacaaaggacacgaactcatccttttttatggctgtatagtattccatggtgtatatgtgccacattttcttaatccagtctatcattgatggacatttgggttggttccaagtctttgctattgtgaatagtgccacaataaacatacgtgtgcatgtgtctttatattagcatgatttataattccttgggtatatacccagtaatgagattgctgggtcaaatggtatttctagttctagatccttgaggaatcactacactgtcttccacaatggttgaacgaatttatactcccaccaacagtgtaaaagcattcctatttctccacatcctctccagcacctgttgtttcctgactttttaatgatcgctgttctaactggtgtgagatggtatctcattgtggttttgatttgcatttctctgatggccagtgatgatgagcattttttcatgtgtcctttggctgcataaatgtcttcttttgagaagtatctgtttatatcctttgcccactttttgatggggttgtttgattttttcttgtaaatttgtttaagttcttcgtagattctggatattagccctttgtcagatgggtagattgcaaaaattttctcccattctgtaggttgcctgttcactctgatggtagtttcttttgctgtgcagaagctctttagtttagttagatcccgtttgtcaattttggcttttgttgccattgcttttggtgttttagacatgaagtccttgtccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccacttattaaatagggaatcctttcaacatttcttgtttttctcaggtttgtcaaagatcagatggttgtagatgtgtggtgttatttctgagggctctgttctattccattggtctatatatctgtcttggtaccagtaccatgctgaaaaactaaacaatttaaaaaattacattttatagtaaacactttatataagcctccatatacattggaatctagaattgggatttgttaacctcagtgtcgtaactgaaagtgggtgtggagaaacattgcttgtctcttggattctggaaagtatcagtgtagtgtggacttacaaatccacagagacaatgtatctgtccttgtttctcgtaagaaagaaaaggatttaacgtttattaagttcttcctttgggtctggttgttctatgtacattttaaaaatatatagcccaccatggtggttcatgcctgtaatcccagcactttgggaggctgaggagggaggatgcttgagctcaggggtttgagaccagcctgggtaacatagtgagaccctgtctctacaaaaaataaaaaaattagcttggcatgtagatgtgtgcttgtacttccagctacttgggaggcagaggtgggaggatcacttgaacccaggaggtggaggttgcagtgagctgagattgtgccactgcactccagcctgggcaacagtgcaagaccctgcctcttaaaaaaaagaaaaaaggtaaagtgaaacttaaaaaaaaaaaaaaaacgcacacacaggcgttcacatgtgcatatagttttgttttcgagagttggggtcttgaccgggcatggtggctcacacctgtaatcatagcactttgagaggccaaggcggcagatcacctgagtcagaagttcaagaccagcctggccaacatggtgaaacctgtctttactaaatatacaaaaaattagccaggtgtggtggcgggtgcctgtaatcccagctactcaggaggctgaggcaggagaatcgcttgaacccaggaggcagaggttgcagtgagccaaaattgtgccactgcactccagcctgggtgacagagtgagactctgtctcaaaaaaaaataaaaaataaataaaaataatagagttgggttcttgctctatcagctaggctggaatacagtggtgtgaacacagcttactgcagccttgaatccctgggctcaagtgatcctcctgtctcagcctccgcagtagctgggattataggtacatcacactacacccagctaattaaaaaaatatatatagtttttgtagagacagagtttctttatgttgcctaagctggtcttgaactcctggcctcaagctatcctcctgcgttggccttctaaagtgctggcattgcaggtgtgagccactgcacatggtcttatatgtttttatgtttgggacttttaggctgttgatgttatttatacccatttaataactgagtgaaccaaagctcagagagattaaataccttatctgagattacagagtaggagattcaagtagggcttcaaagcctagacttagtcctctttgcttcactgcctctcaggtaaaggaatgtgaagactgtgtcacattccagatacatttggtaatctggctgaaatgttctaaagatttaatttgtgtttacttcattttggtttgaaaagccactataattcatacgtgtaactaaaatagttaaacatttaaaatgtgtgccatttaaaaaatattgttattaaagaaaaatattcatacgatactaatgtgttattttaactaataattgaaatgtcagtttttagtaaacattattgccctagaagtagtctttttttttttttttttggtaagacatggtttttctgtcacccaggttggagtgcagtggcgcaatcacggctcactgcagtcttgatctcctgggctcaagtgatcttccgacctcaggctcctgagaaactgggaccacaggtgtgtgccatcacgcccagctaattttgtattttttatagagatggggtttcaccatgtcccccaggcttgtcttaaactcctgagctcaagcagtcacccacctcatcctcccaaagtgctgggattacaggcatgaaccactgtgcctggcccaaacagtcatgattagtggacttgctcttttaacagtgaattgctggctttaaaaagcaaaaaaaaaaaaaaaaaaaaaaaaaaccccaaatctaattcatcatttagttccttttaaattaggctgcatttaaggaactgcaattcaaatattaaatttctgggttaatttttagaaagcataacttatttgatctttttaagcacatttgtgtttttgtagtagttgagttcattatggactctggagacaggcagactgcctgcatttgaatcctggctctgcctttcactggctgtgtgatttcaggcaagttacttaatctttctgtgcctcagtttccttatctgtacagtaggggttatagaaggaccttaagtcaaaggcttattatgagcatccagcgatacctgctcaacatgtgttagtgtgatgaccttaagttgtgaaaactgtatttgggttatgtgccatttctgaaggccatgatccccagggaatatctcgtgatgaccctcaagcccttgtcctgaatgaggaggaaaaggtcaggcacaaccttgtgatttccccggtgttggacttctgtgttcaccagcaggatctccatttctataaccaaatggctacatcttgcatagagactctaccactgtgtctgaaggtatggcaacatttcacaaatttggatttatctcattataaattttaataatttaaccggattaagatgaagctcactcttctgtctatggtggcattatttgctaaccttcaccctcttgcagccatcccccacattcccctatctgcagttgtggcgcctaggaggatagtagatatgccgtatagccaatgacagtatgctgcaagcacaatgcccacctgtgggttgggctcagaaccgctctactgcctaacctggactctggcccctctctcagaccgcagataacaatccttcagtgctggttttgctttcatgcttctttaagcactaaattcctttgacaccgccttgctctcgcagctgctctgtcccattgtattatagaataagcacatgctagcgtacctgcaaagcaggagcaataaaaacaatgagaggaaggagggacattgtgggcacaagttagataattgacattcaaacatgaaggaaaaaattagaaaagttagaacttggtagggctgtcatactgcttatttatttgcagcaagttctaatgacttcatcttctgaggagagagagagagagagagagagagagagagagagttagttgacgtggtgaggacaggcttcctgcagtcagctggctccacatttggctttgaggatcggcaggcaaagtgctaggggtcagcggagacatagtggccagttttggcagaagggagatgagagaagtagtttggaaaagaagctgaagactaaatgataggaggccttggatattgagagtaagaaacttgaacctgattctttatgttataaatatcttttgaagggttttgctaaaggagtgtgacgtggaaggggtattttagaatgaagaatctggaagagtgttgctggagaggttgaaaggtagagtgactggagggaggagacgaatttggacaatactataatggtataggggtgaaaaaggtgtctgtgtagagtgctggtattggaatgagattatgttaagagtcactccattattctccctgttagcagttggttggactacatgtactttaaagtcataagatgtactttaagaaaatgtcatatacagtaatgctgacttttcactcagtccttttctgtacgtgagtgccttatgctaacagagaatctactcagagtcattgagccaagacaccccttaagaagaaatagtagtacctttttccggttctgtctgtcaaggttggtggtttaaatcaggatttttcagtctgttttacagagcctgattacttcacaagtttataatatttttcaagttttctgaattgagattttaagatgatgtgatgatgtcacttgtgatttgccaattccgttgtgttgtttttttctttctttccttttttttttcttttttgagacggaatcttgctctgccgcccagattggagtacagtggcgtgatctcggcccattgcaacctccacatcccaggttcaagctattctcctgcctcagcctcttgagtagctcggattacaggtgccgctaccacacctggctaatttttgtatttttagtagagatggggttttgccatgttggccaggttggtctcgaactcttgacctctggtgatccgcctacctcagcctcctaaagtgttgggattacaggcgtgagccaccatgcctggccctttgttcttttttttttttttttttttgagacggagtcccactctgttgctcaggctgtagtgcagtggcacaatctcgactgcagcctccacttcctgggttcaagtgattctcctgcctcagcctcccaagtagctgggattacaggcatatgccaccatgcctggctagtttttgtatttttagtagaaacggggtttcaccatgttggccagactgttttcgaactcctgaccttgggggatccacctgccttggcctcccaaagtgctgggattacaggtgtgagccaccacgcccggcacctttgttcttcatttattctcccatctactctgcagtgacctcactgttctcagtaaatgaattaaggacttgatcagaaagtacacattggaaagctaagtacaatttatcttttgctcttttttcttatttggaaataatttcatacttacagtatagatgcaaaaagagtacaaagaattctcatttaccctttacccagattcctcaaatgttaatattttaccatgttggcattgtcattctctctctcgccctctttccttcccgccctttatacacacacatacatctcttccctcgtactcattaatttttgttctgaactgtgttagagtaaattgcagatatgataccctttaccccaaaacaatagcattcacttacctgatcacactataatgatctatatatttattcaaattgggcaagattgtcccctactgtcctttatagggccttctttcccctggtccacatccaattcaggctcacctgttttatgtagttgtgatgtctttttgttcccctttaatctggatgattttctcagttttctttatttttcataaatttgacatttttgaagaacacagatcacttaattgggtcctcaattcgtgtttgtctgatatttaaacattagattcaggttatgcatttttggctgaagtacgctgtgtccttctcaacataccatgtcagggggcacatgatgatgtctcttggttccattccccgtgatactaactttggtctcctgttgagggatgtctgccaggtttctggcagtgtcctctagtggttgttttactgggtgctttacagaaatgggaaggggaaaggacttgtgtgtcactcaatttttttttatatatttattttgagacggagtctcgcactgttgcccaggctggagtgcagtggcgcaatctcagctcactgcaacctccacctcctgggttcaagcgattctcttgcctcagcctcccaagtagctggcattacaggtgcatgccaccacacccagctaattttttgtattttttagtaaagaaggggtttcaccgtgttagccaggatggtctggatctcctgaccttgtgatccgcctccctctgcctcccaaagtgctggaattacagacgtgagccaccgcgcccaactgtgtcacttaatttttttttttttcactgtcttctgaatttccccttttcttcttttctctttaccatgcagttttcaaagaaggtctccttttctaactactttgttttcccccaaacagttgcctttccaagggactgcctcctagagtcccaaggtgtatttttaagttccttttctgtagtatgcgatgatgcaccttcccccctttcctccatctcaccttagtattttcacatttagatgaactttgtcttttagggagtgattttagatcaatcttagggccacatctaacacccccttatttcttcccttccatttttctctgtatactcttgttcctgttagggcttatagcagaaacttgagatatacagtcagttctgttacaatgcagcgtatgcattcttgaaaatcattgtgctatgcaaaattgcacaataaaaaccacagcgcttgtggaaaaaatgaggtttggggtatatattagtttgtagggctgccataacaaagtagcactgactgggtggcttagacaacagaaatgtatcttctcacagttccagaggctgagtctgagaccgggtgtaggcagggttggtttcttctgagacctgtctcctgggcttgcagatgccgtcttctccttgtgtcttcacatggtctttcctgtctgtgggtctgtgtcctgatctccttttcttacaagaatgccagtcagtctagattaggcctacctacatcatctcatttgaccttaattatgtctttaagggccctgtttccaaacacagtcaaacctcaggttatggtgttgagggttaggacttgagcacgaattttgggggacacaagtcagctcataacaagtcacagtgctcaaaacgtcaatgacacattacaaaaatacagaaactagtaaaaactgtagcaccattttacccctgttaaatcattagaaatacataaacattccagtaaacatggcactttacctcggaaaagatgggaagtttgcttgtgggagtgggcataggaaggagactgtagcgtgtaatttattttgaaatgatgcaggcaggtttatcttatgtcagatggaaagttagcaccagatgaatgggtgtggcttacaatggctgtggtgagccagggtggctggcagatgctccaggtgtgctgtgtgcttgtgcctgtgtgtgttttgtatattattcctgccagcttggttctgctgggtgcagttttctgcattcacctagtatctcagcagatgaaaatacccataaaatgcaaaattctcattatgctaaagttgttctctaatatatcaatcacatttgaacaccaaattttgtgtttttaaaacagatattacagcagaactgatagtagttcactagaatttgatgttcacttttttacttacaggtaatttgaaattactctagttttctgactaggcatggatttatgtagtcccacttgttcttgctttttaaaattgtctttttatatttctggagaaggtgttgggaggtttgactttgcacagctgccattactgctgctactcagattcttctctcaacagttcttatctatttatttatttatttgagacaaggtctcactctgtcatccaggccggagtacagtggcgagatcttggctcactgcagactcgacttcccgaactcaggtgatactcccacctcagcctctgagtagctgggactacaagcatgcaccacaacacctgtctaattttttgtattttcagtagagaccagtttttgtcatgttgcctaggcttgtcttgaactcctaggctcaggtgatccatctgcctcagcttcccaaagtgctgggattacaggcataagccactgtacctgcctgaacttaccttttttttttttttttaaaaaaaaaaaattgtttacaatacattaattttgtggagtaatgtatttcaaagcaaaaatttataactccttttcctccttccatatgccttatttgtataatgaatttgtccatatttgatcacagtgtagggatctgcttttccctaaagtttcattatttcaataagaattgaaaatctttagctcaaattgacctaaactaatttttgagcaggtattggaatgaaataaggcatttctcactttgcctgattctgatgtgcacatatgtcagttatgatggtttacttaaatgacaccagtcccccagcaacttgattgaaatttcaccttccacagtttattaactgcgtaaagtacagattttgcttttggcccttcagtccacaaatcctgtataagtaacaaatgtgcatcatgatcagtgacaaatctcatttctttttcaactctatcagtaattgtcactgttaatctgttattcagttcatacacagacagcaaagtatgtagttgtattgcttctttatgtcacccactgataaactcacgtaacattttgtaagaatgaatagttgaaagacgaattagccaacaaagataaaagtgcagcgaagaaatgaaaagtgataaatgctcgaagtgaaattggaagtgattagaagatctgaaaatattgatagcaaagcaaatgtgggatgagaggtagacctgcatgaagcagtggtatgaaccatattgaatcagtcctgtgaatataaaaaacaaaataaaatcaagtcactatgttttagtttaaattttactaggaacagaaagctgcttatggctaaagtggagtattactttcactttggattgaagaccgtttaaaaaaaatcccaatcagtttggttagcattaaggtaaaagtattgaagttagttgccacattgaaagaaaatggtaattacactgagattgaggaagaaattctaccagtaaagactagcttcatcattcagaagttggcgtgagttgattaatctgttaggtgaagctgtagcacagagaaggatgctgctgggaaatttgcatccagattccaaggattatttaaggtgggtgatgataatgatcatcaaatatttaatattgatgagataagttgtaaggcaactccatcaggaacttgtgccacagaagatgtaagatcgagaagtagctttaaggagttaaagatagagcaacttattaggagacaacacaaaaggtaactgtaaaataaaatctatgcttctctgtctgagaatcctagagcattaaaaaaaaaaatcatgaaacaggcatctcagccagtcatttggcatgcaaataaacgatcatgggttacagtaccattgctccaagacttgtttcagttgtgtttttgtccagaggttggcaaaataattttaacttttagagcacaactactactgttggataatgttgcaagtcaccccagttctcttgagtacttaaaagaaaatgtgaaaatctgctttttactacaaacagaaacttcattaatccagccagtgaaccaaggagttatttgagcttttaaggcctgttatcttagatggagtttcagacaggttattaatgctacaagtagagattatgcatttctgtagctgaattttggaagaaatatgacataaagcatgcattagaaaacaagcatcatagcgggaagtaacagtgagtaatgtgtgtgcagtatggcagaatgtttaccacactgtgcaaataaccttgcagaattcgaattgaacatagagttatagaagaaacacagtcacacgctgcataaggacattttggtcaggacggactgcatatataacagtggtcccataatattaaaataccatatttttacataccttttctatgtttagctacacaaatacttaccattgcgttacagttgcctacggtattctgtacagtatcatgctgtacatgtttgcagcctaggagcgaaaggcctttccatatggcctaggtgtgtagtaggctacacctccaggtttgtgtgagtgcagtctatgaggtccgcacaatgaaatcacctaaccacacatttctcagaatatatctctgttactaagcaacatataactgtagttgactttgtgaatgttccaccatttgagagacttcagatatgtactcataggaacgtagtgagggcagatttttcagcataaatgaggaaggatggagatgtctcaggggaagtgatgctaccaaatgtctttactttaaaagagataatacatgacattgaaagtacaaaggaaaaattgttgatagtgaatccaaacttaggaaggagtattgcgacttgttaagatacagaaaagatacttgctctgtattgtaagttatacaacaaagaaggcaaaccctgttcaaactacccgattagtttttttttacaaagaaacaaaccctaattctcagtgtttctaatgtttcaaattgcagtatactaaatactatttttactatatttttcatttgcctatacacttatagagaattttaaacgttttgataaaaattctcaaaggtcatggaataattatactctgttctcataattattaaaattactttgcatatttcagcttgcaaggtaatttttatggtgcagcactaccatgcaaagcaaggactgcctttccaaacaataaacgttctttgcctcttcctgccatcactttccttcagcaaacatcaccatcgttttattgtctttattgaactcttcctagactcttagtagtattccctttactctttggcaccttgtcctccagctgctccttgactgacatttcttcatcttccctcttttctgatctgctgtcttgacagctggtttttttgcaggaattttaggttgtctgagtcacgagaaactaccattatagtagtttcttcagccattcttcttaccccattccttcttcccacagaggcccctcctccccttccagcatcatcatttcccccttgtctagttaatctaggttagtggttatttggttattctagagcatgtccttagggtctcatccacaatcccaaagccttatcaagggctttgccttttctaatgtattcatctttcttttgcgttccaagaagtgcctttatttcctggtgttccatttttgtttttctctctagtgccttggtgagatgagatgacttcaaaggaaggagcccttttacatgagtgcctagcagtaaaaagctttgagataaaacagcgatttccattagggacaaaaagagggtagagcaaagctgtaagactttcttcagtgaacccataaaggggaaaaactggaactattaaaaagtggtgacggtaaaaggaaagcaggcagacctgttcacgtggccacacagagattagaaaataagtgtcttgggagatgtttagtacttaaagtgtgccaaggtgatgttgactgccagtagctcctcactctttctggtccacaccccacactgccagctcacccctgccctgggctgccggagtagccatccatcagtggagtgcagctggaagctgagaaatctgttctttcatcaccagaagagaagcccagagcccatagccacaggggatagtaagaacagaacaacaaatcagtccagtaaaaaaactggtcacatgatagggaggatgcagataactttatttaggtaagctgtgaggttgagacttctgtgatctggtttgggggcatgacaaaatgaataacctgagtgcgaaacagctgactaccaatgagtgtttggggcataacctcagtgtaaattaggatacgtctctatttcctttatttttcattttggttgtttgacttgacctacgttacaggtcattgctaaattactttggaagtaccctttgtcttgattgtgttactgtatgtggatggtgctcaaaattattaaatttaattcagaagtttcaattttgtgaagagatggtgggtattttctaggtcataatacaaaagtgatttgtgatctagctattgggtgcctcaaattgtataacataattatagttagaattgaatcatcaaataaggtggcaagattaatgggagtggctagctttaatgttccaggttatattaattttagataaaatgaaattagtattcctatggacaattgagtcaagttcttgaattactgtattcagttgggattgactcaatttaacaaaatggtactattagagtttttgaggataatgagaaaatggaactgaaattaaaattgtctcttgcactttggacaaaataatttctgtgagcagcaattaagaaggtccatataagagattcaccttctgctctaatttcatttagtaagattgcatgatcttaagctccgtgatattttacttggaaaatgttatgacttaacgtaggtcagtgtcccctgcattatgtgatttggtgtgcgcatatatatatatatatatatatatatatatatatacatatatatattatatatacatatatatatatatatacatatatatattatatatacatatatatattatatatacatatatatattatatatacatatatattatatataatatatatatttttatatatatttttaatatatatattttaagtagtggcacagaaagaagagattaggagttgatcttcaaaaggcagagaaaattagaactaaggaattcctaccttttttaaaaaagctaaaaataattttgggaagctctttagacagttcacactgttggagaaaaaccctgtgatatgaatggctttgaaaccagcagcagagaagtaggtcctttcctgtgggtatgggtcctggaatggattgggtttaggcccacttggctcacctgttaggaggatgctccttggagccaggccttgtgggtattcttgggcagcgcttgacttctgaggacatgggcacatgttttcaagagaccaggcaaattatagttgtctgggtaccaattccatgtggcagcctccagttaagtgacatccacattctggttaccataaggatttttaatgaccaatggtatactgtagaaaaggcacattttaggcatttagtaaactagaggtattgataactaataataactaatagtaataagtactgctgcagaggtactaataactaatagtaaatgttagactcatttaagagctggattaacaatcattacctctagcataacacaaacattcctgggtctgtgcatttcacattccatttgtttcagagtcttgtatttactgggtaaatgcccatgggaattcaaatcatggttgggcaaagttggtttgagggtaggacagggagtacgggattagagagggtagaagaggtacaagggcctcttctgacttggagtgtcagggacacattcatgtcagggctttggaagggcctcttgactggggtttggtgtgtggagagtggaaagctgagttgggaagccttcttctttcctcctaaattccaccctgataacaacagaaaagcatctttggcctctatgacattaaaatatttgagcattaagggtcaggtgctaggcttgagaagctgtttaagccaggctaaatacaactttagtggagatgtgctgaggaataggtacactgtttcttttagtaactaatgtttaatttttagagaacacagcaggccttttgaaggcagtttaaggaatgggtgtggaagggggtgtgggggaaggaaatctcagcagaatgcttttagatatttcctgttacataaatgctacatacttctcatgccttcagactcatagcaaataggactgaagcccgttgaggcttacatttaattactgttacaaagaatgtagaaactatataggtaatcaaagaaccttaaaaactggcaccaaatgcaactttttctttttcatccaaatcttacattgtggaatttgaatgtggtgtgatgaaatacacttggacaaaaaataagtgtttgatttttaaaaaatgcttttgtttaattcataagactttctgtcatagtaaaagagtctgtcttcaggtagacattccagatgacaaagtgtctcatttatggagtccccagagtagtaacttgatacatttatgtagcagtgttttaatgtgtgcttgtgatgaagagtgccacactgatatcatactgttagtatctacctgtaatgtaataaattgagatcttgtgttagtaatgagaacatacaagttaaagctttctacttctaattttgtcctacattctttttttctctcatttatgttactccctcccccagatatagccaggtttatctgtactagtggctaaaagacacagatactgaaagcttttttttttcttccttgatttcagggaaattgatagaattgggtaaggcatttggggtatttgtctgctgtagcccgtggcattcagggatgagaatagccatcaaacttgtaaatattttctttatataaatgtcatgtctgtcaagttcattgcagtgctcctgtgtcggcagaatgtctcgatttcagaactggctatcccttggctgctcattctggacagtgctcttcacttttgtgagccatagtgttttgtaaggtggagcctcattaaatctatctcacaggatattttttgcctataaaggagttggaatacatgagtgaagcaggcctgagttcgtgtatatttgaaacatgcttcagcagggccatgagaagtcttgtttcagttggtgaacaatctcaagtcatttactcacttgtttttgaaattaattcaaccaatatttgttgaatatgtataatgtgtgttattctgtgtactctgaagtatacaaagatcagtgattacagccctggaccctcaggtgtctagaatatataactagaaggtagtcaatatcataagaaaggtaagatcaaatactttgggatccagggtagtcaaaaccttattggataaaaaggtaatctctcagctctgtgtcctgagagctgaagctctcctaagttgaaacaatgctcttcttgaactatctcctcacaaattggaagcacagagttctgtaggtcttgcaccagagcttagacatgtagttaataccaaggcaccatgtggctgggcaatatggtttctgtcccagcctgtatgacgtcatatatggatttgtcatttgcaccatggaaatttcacatcaggacaaaccaccatggtttgtgaacatgggacatctctgaggaacacagaattttcatatggccacggagtgtggttcttctctgtgtgaactctggtgttgatttttaaaaggcatgcactgattcgagaaaacctaattttatatactggagttagacatacctaggaaataattcatcccattagacatttattgagaacctaccgtatgctagacattgtggggataatgatgactcaggttagtgagggagaataaagccttttatacacatagctcgaatacatgcagaaatgataagtgagaagagatacaagtgagaagtgtggcagagatttaagggagagagaggttatttctgatagatgtgcatttgagttgggctttgtgtagagctgtcatatctcccagtctgcttgggtcagccccagtttactccggatgtcctgatgtcccctccaattaacatctttctggtcaaaattgttccagtttgtgtgataaattatatggatggtccccctagctttgagaatcaggtaagacttggcttagtggagatagagaacagtctaggtaaagataaatggcataaacaaaaaacatgggtgatggaacactttggtgcacttagaaaaaacatgtttagtttgactgtagctttgggaacaggaaagggaatcactggaaatgaaggttgggaggtgagttgaggtcaaattttgagtatcctgaatgccagactagataccttgattttatgtagttggccatggaagtttgtgatttttttttttttttgagatgatgtcttgctttgtcaccaggctggagtgcagtgatgtgatcttggctcagtgcaacctttgcctcctgggttcaagcgattctcctgcctcagcctcccgagtagctgggactacaggcgtgcgccaccatgccaagccaatttttttgtatttttagtagagacagggtttctccatgttggccaggatggtctccatctcctgacctcgtgatctgtccaccttggtcccaaagtgctgggattacaggcatgagccaccacgcccggctgactttttttcttttcttttctttcttttttttttttttttaagatttagaaagatccttgtaactactgcgagatacaaaaaagggctcttttgggtaacagggatttaaaacaaaattcttaggacccattgccaattaaggatcatttagatatttttctaaattagtgggaaaataagatataaattactacagtgtacagtgaaatgtcacaaaacctaaaaaaatcattaagttttagaccatgaattgactttggatctttgagtcaaacattatcattttatagaagaagaaaattggcaatcagacagattgttaaatgtcaaaactctcccagcaagctcttcatagagatggggttagaacctagatgctgtggtttcttgtgcagcgggtatttacctttcctatagagctttattttggagactccattattgactgttgttggggccacatcaatgtctgcgtcttgactgagctgtgatggaacttatcattccgtccctgggtgtcattgccattatatgcactggctgtggtggaaattgttaaggataaaaatgaaaaaatgaggacaacagataccattctcattcagtgaaatagggtttcaaattatggcatgtgaatacaagagttttaaaaaactctttaaatatgaaatgtcattttatggcatatagtattataattttttttttttgagacagagtttcactcttgttgcccaggctggagtgcaatggcacgatctcggctcgccacaacctctgcctcccggggtcaagtggttcttctggctcagcctcccgagtagctggtattacaggcgtgcaccaccacgcccggctaattttctgtttttagtagagatggggtttctccatgttggtcaggctggtcttgaactcctgaccgcagatgatctgcccgccttggcctcccaaagtgccaggattgcaggcgtgaaccaccacgcccagcctctaaaatttatatgtgcatatttaaaaaacattcagaagttgtaaaatcaacagaattgatcagttaggtataaacttacaaatcattggcacatgaaacttttaattttgcttaatcattattgatgctccttgaaattttacgtgttgctataaagctgttaagagttgaggaaggactgactgacaagtacgcttcatgtgttttttacacatttatcgaagactggaaaacctgctagatgaattctaaaagagctgtaacacggactcaaagcttttaaaataattttttttttattttttcatagaagtggagtctcaccatgttgccaaactattcttgaactcctggcctcaagtgattctcctgccacagcctcctacagtgctgggattacgtgtgtgagccactgcacctggccatgtttttcttaatcattatgttttttgggtggccatcagagagaccctgtaaaaaatatgattttggaatgaccatgggatacctaaataatagggtgaatatatttatgcatataagcctaatttgtttatataatatagtatatatgttaaaggaagcaagtaattttggagatttaagactgtgcataaagaagcattaaagtgctacaagttcccctcaaaccagtgaatcactaaatttctaataattatattatcaagtaaatattcatgtaaaattatgttttcattgcaggaacacttttgaaaacccgatttctagctagctttaatataagcaattaggtagacttttacctaagtagagaagctgctgtaaatcactactttctcatggatactaatttgagcttcaaaagaacagtatcattcaaaggatgcttttatttggaaagtaggttttcaagttacttgaaggatagttggtttgttggaaaaagtgaacagaaagctatagcagaaataatgctgagaggattagtattccagatgcttattaacttaaaaagacacgaacattagattaacagttattgtgccgttggccagagaatgatttccactgtagaaaatagcgggtcatgcttgatccattatctgtcttaaaacagattcaggaggcagacacctagagtcacaatgggggaccagctaaccagttcagcctcactgaggctcgaagtgtataaactaaaacattccatagccttgcacaaacatgctcttcagacacctgacaacagtttcaggggcttccttggacaaactttccagctctcaagttctggagtcagtcattaggatgcctgtggggtacgtggacggtgggtggggtaaagaggaaagcactttcgaggagagcaggcttgggaacatgtattgcaaagggttggcacagggagaggtaaaagtcctgaaggtgaaacctggggagcctgggatgctgagatgcacttttgtgacatgattttgcatttctgttgattttcatactatttattgagagcacggtagaaataacagggaagagaaataaatagtcatcatgttgtgatttatttatttatatttttttaaagtgacagggtctcgctctgccagccagactggagtgcagtagcatggtcatagcttactataaccttgaactcctcaagtgatccttttgcctcagcctcctgagtagctgggactacactagctaattaatttttttttttttttttaatagagagtctcgctatatttcctagactggtcttgaactctgagcttcaagtgatcctcctgcctcagtctcctattatgacatttagaaaaagtaatttcttcaaatcaatttggttttccactttgtaaaatgaagagagaatgtaactgatgagagcttacagtgacatccattatttcagatgcaaccataaggaagcttttctaatcaaaggccttcatttcttctttgtactgtttacagggttcttaacacaaactgccttagattataaacatttctgcatgtgccttatctttccaattagactcagtctttccaattagcctcattgagagcagggtcaagggttaaaaataaaagtgaaaacatttatgttgtgctttaactctttatagaatacttttcatatatattatttggtgtcttttaacaatatattgactgggatttccaaatgaaaactggaagaacaaggtataatatttatgttttaaaatttgatttaagattcactagagtttagttatactaaaagtgtatattggtaatatcttcatatttttatattatgtattttggagtactgaaaaatatactttacataatctctgagcaaatgtaactaaagttttatgagatttctttagaggtaaatttgaaatcagtaaataaacatggtagggaaacttttctgacttttaaaattaaaattggaaacttagtgggagattttaaaactttacgttaatcaaagttatatctgtaaatgattaacaaacactcaaatggttcccaaagcaaagacaggcatcctgtgacccactactctcccccacacttgattcactgtctctacagtcgaccacatttacatatttaaaagtttcttttggtatttgccgctgtgtttttaaataactttatctatctatcttgacttcttagctttggattttgagaactgacttcccgccctggttgaggattcagctttcttactgtgccttcctcatgcacatgtgcctccctcccctcatcctcttggtgttttctatcaccttgtaaagaaatcagtagtctgtgtgtacatttttatgactatgtaaatattattcatggatgacctatctggtgtactatgattgcatttccttttgttttctctgtagttaataatcatctcttttttccattggcttacttctctatattcctattaccaatttgtggccagaattataaatctcctttcagtacattccaacacactgtgtattctgttggtttggaacctcctgcaccttctgttcttaatttcaagtttgtcctggttaatcattgtaactgctgcacactgtcatcctatggcctccatttactgtcatcttgtaggtttcatttgtcattttcctgtgttgggtgctcatttgctggatatcatgtcttccagttttcttggtttattctctgttttggtggagtagcgttggaaagggagcatagatttgttgaggctttgcatctccacagatgccattattctgctctcatatgtgattaatattttagctagggacataattccaggttggaagtaatttggagtaaaaattcgatggtactgctttactgacttgtatattccagtgttgtgtttgagaggtctgatgcttttatgtttcttgttttttttttttttttttgttattgttatttgtttgtttcctctttgtgacctgattcctctctgaagtttttgggttttgtttttgccctcatgttctaaaatttcacaatgttgggcattgatgtaggccttttgtaaccattgtgctaggtgggtcatatataatcaagaaaccagtgtcattcagattcagtttagggaaattttcttgcactagtattttgataatatttttctctttgtatttactttgttctctctctctggaactcatgcaagtcagatattagacctcctagattggttgttcactttccttatcttttcccttctgtcttactctttgggaaattttttaaacttgatcttttaatttgtcaatagatggtttctgccatcatattgttcatttccaggaatttttaaattcttttctccaaatatttatgtacgtatttatttacctcccctccccttctctcccctctcctcccctcctctcctcaccccacagggtgctctgtcacccaggctggagtgcagtggtataatcacagctcactgcagccttgacctcctaggttcaagtgatcctcccacctcatcctcctgagtagctgggaccacaagcatgtgctgccatgcctggctaattttttaatttctttgtttttgtagaggtggggtcttgttatgttgcccaggctggtctcaaactctcaggcttaagagatcttcctgccttggcctcccaaagtgttgggattgcacgtgtgagccaccgtgcctggccacatatttttcttttgatagtaacctgttctatctctctgaatatgctaattgaagttttcttcaatatctctgaagaaatgaattcttcagttttattttttcagtgttgttttggtttctgctttcattttaggggactagtattcttagcttttgcgtttgagataagtaataccaaccattctggctcttcactccttccagacacaggagacaggattaacttccctgcctccatctgacttgttttgaccagtggattgcaagcagaagtgatgtgcacgtctcccctacctggatgatcgatgcttgtgttgagattggagatgccacaggcacccaagatgcagtgtggaatgctccacactgcggggggccagctgcccggggattcatccagagccactttggacttggcttgaatgggaagtaaatgtttgttgtttttaaccactgagactttggtattgttttttattgcagcgttatctagcctgtcctactgagacagctctcagtcatatttaagaatgaggcacaaaaagctgtttggaagctctctactagtgggtggggtagtcatatggcagtgatctggcttagcatttctgttaaggcactcccagatgttaatgtcagtagatcttttctcttggtctggtcagttttcccaggaaaaaccctccaattcttcggcctgacaaatgtaagcccaactcctgggttctgcaaactgagtaatggaaatggggcttgggatgcttgctgttcagtgtgtgcacactctgtaatgttccctgtttttaataaggtactcctttcagcagtccgagccacctggaagtccacggcccatctgattaagtctttctagagaataaaccttctgtttctgcccaggttgggcaaaggcaggcagggggtctgactgcttcttaacagacttctggcaagtcctccatggtcacaccctccgtctgaagtctgtggtgctggaattcctgagccgtttcaggcttttgcagtatgaatggatctgcttctgggctttctctattgctaacctaggctttctgtttctcatgtctcctgaatcacttaccacgctgcagtttgcttcccaccgtcccaaattttgttgttctcatccgctgaccttcccattgtccttttgtgtttatgccttttaaaaaatcccctttctgctattttctagagggaatgtaggtaagcacatatattaaatctgtgtagtgtttactggaagttctttaataatgaattttatcctcccaactttttattttgaaaattttcaaacataagaaaaaatgaaaacagtagaatggacaccattgtatatatcctgctcttagatctgacaattaactttttgccaattttatcatctccttttcctcctctcctccttctccttctcctttctctctctctctgtctctctctcttttgcgctctctctctctctgtaatattctacaagtatatatggtatatgtaagataaatatatctatgtctatattttctcttttgctgtaacatttgaaggtaaggtacagatattatgacccgtcactcctaaatagttcagcatacatttcccagtatatatggtatatgtaaggtaaatatatttatgtctatattttctctcttgctgtaacatttgaaggtaaggtacagacagctattatgacccttctctcctaaatagttcagcatacatttcccaggaacaaaaatattctcttacaggactataattatcatacctatggaaaattaaaaaaatagttccataacatcatttaacatctagcatgtctaacatcatctgacatctagcataaattatatagtttcaaaatttcttatttatttatttttttgtttttgtttttgtttttgaggcagtgtctctgttgcccaggctggagtgcagcggtgtgatcttggctcactgtagccttgatctcctgggctcaggtgatcctcccacctcagtctcccaagtagctgggaccacaggcacacgccaccacacccggttaattttttgtattttttgtagagatggggttttatcatgttgtccaggctggccccaaacccctgcgctcaaatgatcggcccacatcagtctcccaaagtgcttggattacaggcgtgagccaccgtgcctggcctcaaaaattcttttataactttttttgccttaaaaattgcgatcccatcgtggtaaacatgctgcaactggttgttatttctcttttggactagaacagtttctcaaagcatcgttttttgtacttgattttttgcttttaattaatcttgaacagagctagcacctatagaaaaagataaataaagatgaggccctgataaggagatgttcgtgaaagcactgggaaacagagcacattttattttttaatggtttgtttttctaacccaggtgctactagtctaaaacttagccacgcagtgctttgcacattcaattaaaacaaagaagcagtatttgtcttcactgtgatgaagaactatatttagagttttcccagcccacctcacttcaccttgcatactttgccagcgttcagcctcatgacttatgcttgcttcaaactgaatttgagtctaagctcaaagggcatgcatttttgtttatgaataagggctgatctctgaagttagtatagttatcaaacattcctcacattccatatgtctaatttttagtgcttggaggatctggtgctgtgccagaggaacatagaggctagagagcacacagaaatatcaccaaggaaagtctccatgtaagctataaaaattcaatcgtatgtttaaatagcaaagcaaatagtaggtatgggattgatttgtggcatgttagtaccattctttaggctgcttaggaacgtttcttagttttctcttggttcttgaaattccagccccggagcttaaaaaaatctgtgattctttcagtttgtcttttagttgtactcagggccagaataaggagattttttattttttatttatttatttttttgagacgcagtatcactctgtcactcaggctggagtgcagtggcacaatctcggctcactgcaaccgccacctcccaggttcaagtgattctcctgcctcagcctcccgagtagctaggattacaggcacctgccaccacgcccagctaatttttgtatttttagtagagatggggtttcaccatattggccaggctggtctcgaactcctgacctcaggtgatccacccaccttggctcaccaaagtgctgggattacagccgtgagccaccatgcccagcccttttatttttatttttgtttttttaaatttttttgaaccactcagactgcatcctctccttactctcacaggggaagagaagaatgatcatcagtggcaaatggcagctgcagccaagcaacaccggcctcacactccaggcagaacgctgtgccctcctcatggaggagtttttcaatactgcaaaacaaatacttgcagaagctaagcgtgacttagtgtacggttgaaggagtcaccagtgcagatgtggtggtcaccagaagataggttcattgaacacatgttgaatgagcagcagtcgctgttctagccactaaggaccacagtggtggacaaaataagtcatggggaggtaggaaggaggactagagcaataaaggagataaattcagacatgataatagcattaaagaaatcaactgtatgccatgatagatagtgactactttagatagactcatgcattagtcagctctgctgtggtaataagcaacctgtaaatctgtgacttccacaacaggtgtctccttctagctcgtattacattgtcaactagagaataaagtgaaataattatgtaaaaatctcaaggctaaggatcatgcatgatctgtgaaattggtcactaaatgtttagaaaaaattcaaattggtcttggtgaaatatatgcataacacaaaagagtcagattatgacaataaaaatagaacctttgtaaatttaatataaaacaatttaatacaaagaaatcaaagaaggaaattgtagggcctttggtcagaagctcctttgttgtttaacaaggttcaagaataaataaggctgtttcctcttcttaataaatacattatatataaaaaagtgaacattttgtagaagcagactataatagaaacttgaatctaagtttaaaatgccttagatgatgttagaaaaaaaaagagtaacatttatgaacatgggcatatattttttggatgtctataaatagtcatctttgaaatgttaagcatgctttccagcatgtgctttttctctggcctgagaagctacaggtgcaccgagattgattgactcatttaccttcttaaagcttttttgggaagcagttagacttggtttaattgtctagtaatctggccagctgcctccatgatcttcacattctggaaggcctgtgcttaactgaatttcttcttcactttgggaccctgcaagatcactgagagtcaatgctgggtaactccatttaggtcagttatgtagagatcccttagttaaagaccaggccctgctaacagcatcactatagcgttaggacatttgttcaggtaaatcccacagaaatgcattgatcatgtggccaaaccaacatactttcttcttgcatttatccaggcaagattaagagttgagatatactgaaataacaccaacctcacattatgaacattttgaaatttattgtgaaattcatttattttgtctctaaatgtaacaatagctgtagactgcaaaagaagttaaaatcagggccagagagtggctgatgcctataatttcaactcttcgggataccaatgtgggaggatcacttgagcccaggagtttgagaccagcctgggctacacagtgagaccctgtttctacaaataaataaataaataaataaataaataaataaataaataaatttaaaaaattagccaggcatagtggcacataccggtaagtcctagcttactcttgaagctgaggcaggaggatcacttgagcccaggagttcgaggctgcagcccagcctgagcagtagagcaagacccctgaagtcttgctgtgctgcccagtctctttaaaaaaaaaaaaaaaaagtaaaaatcagaggatggaactgaagcaccagatacttccccacaagctattaaggctgagttagttcttataactctccactgacagcagctgtgcctttacaccagggagcttgctgcatggaagctcggactcagtctgatctagctgagctctccgttcagaagcagcaggcttcagggcgcataatcgagaactacaagtaaggctaaggcatcatggccccaagtccccttactgcaggagctgcatagcaggaagtgcttcctgaggttaactttatgaatctgtgtctgagtaaaatacttgtcagtatctaacttagggctcattcaaggatattcagtacagtgttgttttggatacaattaaaatggctatcagtaccagacaatactggaagggctaaactgtgatctaagcttattgtaaaagatgctcctgtgacataaaacaaaatttaaaaaaacttactattaaaaacgaggtagcaacatgaaaagcctcataaattatattgttgaatgaaaaaagtaaacttcagaacgatgtgcacagtatattatattttctaggctgtatgtagagaaaggcctggaagaacacatactgccccggtggtcgtggatacttctgaagagaggagtgtgagaactggaatgagagctggtggtcaaagagacttagcattgtctgcagtattttaatactttacaaggagggtatatccatgtattttttaactaaaatcttatattaaaagtaagattttaataactattttcaaaagaccaccagctgctgtgtggagtatgggttatagagggatgagagtggaaatgtaacaactagttaggaagttaatcggggcaagagatgctaataggttggattagagaggtggtggtggaggaaaaatagttgtaaatagggctgtgttctggagggtgagcctacaggatgttgacggagagggggccatcaaggatgaccgcctcccgggttgtgaggtgagcatctgggttgatgatggtgccattttccaaacaggtcatttgggggaggaatgggactggggaagtggtcatgagggggaagttaaagcgttgttttttatgagttgtttgatgtggccattagataccctgctatggaatgatcagggagatgctctctgataaatctggacctctaaggaaacgtctctctggaaatcactcactcactgttttctctaacaaacattgagcactgtgtaccatgtatgtgtttggcatgcagagatgaaacaaccgctaggaactcggtgaactgaacagagaagtcaactaaaaaatgtaaaccgtgtgaaatattttaatgggaaaatacttccagagcttaacaatgtcactaaatagtgacagctttgggaaaacatgatgtcttccccaagaagatgatgtttgaattaatttttaaggacgttgaatcttagaagaagacaactgtttaagtgtgaaactataaaaggggcaggatggtggaaaagtggagggagagaagatgttccaggtggagggaactgcacgtgttaaagatatttttgctacttgtatatcaggcggactggcttctccttgacctctcctgggcttcttttggtagatttttcagtagttggtgtcataggcatctgcaacgcagatatcctgcctctgagctgtgaagtagtacttccacactttgccgtcttgtctcatgatttccttgtattcatgagggtatcttgttggtattagctgacgtttctttcttcttagatgtttagtattcgtagaatactgtgcctgtaactcatgccaacgatgttctgaaacctggccagtctcaccaagcttgaagtctattttattttatttattttttgcctctcaaaagctagactgggatgcaaacatttatagcaacatcattcatagtagctagaagtggaaacaatccatatatctgtaaactggtaaatggataagcaaaatgtatctgtggagtgaaatactattcagcaataaaaagaatgaattcttaatgcatgctatataataacattatatatcttgaaaacattttgccaaatgatagaagctagacacaagaaaccacaaattgtatgatcttatttatatgcaattccagaaagggtaaatctgtagggacaggaagtagatgagtggctgcctggggcgggggcggggagatttcccacaatttgaaaaaacttacgtgaactacatagtctacaaacactgaaaaaaattaagaaaaaggtatggcacgaatgcataaaatatatgtacatactagactgttttattatttactaccataaaatatacacaccattataagactttaaaatttatcaaaacttatgcacacattacaaattgtgcatgatgccatttgtagttgagagaaatgtaaacaaatgtaaagaggcagtattaaatcataactgcatataattaactatagtatatagtgtactactgtaatgattgcatagccaccttctgttgtggtgagctcaagttttgggagcatctgcttaaaatgccctgtgatgctaatcatctctgtgtgagcatttcctctctctggtaaattgcatatcacagtaaaaagtgatctctcacagttctcaagtatttttcattgtatttagtgcaatacgtaaacctttagtacactgtgggacccatacaaagtgccacttgtgatgctggaagtgctcccaagaagtggagaaaagtaatgaccttacaagaaaatgttgacttgcttgatatctacggtagattgaggtctgcagcttaggtttccaccatttcagatggacgattcatggtgtataaacagataacctaaacttgaagcatcaataaatacagtacggtactgtaaatgtatttctttttctttatggttttcttaatgactttttcttttctccagcttagtttattgtaaggatacagtatataatacagtgtacaaaatacgttacttgactgtttatgtattggtgaggcttccggtcaacagtaggcagttagtaattaagttttgggagagtcaaaagttataagagaattttcatctgtgcaaggagttagcacctctaacccctgcattgttcagaagtcaactgtacataagtttatacatggactgaaaaaataccaaagtattggagtagatgtcactctacaggaaagtgaagcaaggactttaataacagttcatcctgttattttctgtattcttcataatgagaatctattaactgttttataaaatgtatatttttaagtcaacattgaaaactacagtatacatagagtttatttagtttgataccaaaatatgatgtatattttgtacataatattatatctacatatgtatatatttatttaaaaaacatagcctagagtgaaacacatcacattgttaactgggattattcctatgtagtgaggttatagagattttttaaagtcctctcagtttcttaagttttgataaaagtaatacaggtgtattttaatcatttaacttcttcaaaagggaagttgtggcccttcagaaaggtgtgccatgtgtcatttctttgttgtcctgactggagctcaattctccagactgaatactgaagcctcttctagtcttcgtccatgagcaattattatccaccatgaaattgactggctgtgtgttgaactacaggttgggaattgaggcagccttggtggatttctgttatttgtttggacaataatcctttttaagttctctacctctctcaaacactcataccttctttgctggcatagccacttaaaatttcagactatttttcaaaaccaaataatctgacaagcaaacatttcttggcacttaggagagaaaaagaggttcaggttaaagtgtttgaccactttgttttcttccgtggcataaaaatactttaaaaacctgctgaattattgaaatacttgagataaattctgttatgtctgtcacttaaatctgttttctgttaagatattcattatgatacagaatgtaataatagcaaaaataaatcacaagaccaaatattttgatgcagtattgaaagattttcttgtatcttgttccatagtcaggaaacatatgtatcaactaacaccttaataccagccttcatgttgttatttgaataaatgcatatactattacttctgtataaatagaaaatttttgaaagaataaattacaaccctttcatgatgtagttgacgttttctttctgccttccttcctactcttcttccattcagtcaacatttattatgtgtcgactgtgtatgaggtaggcattaggcattgtgctagagagcgagaagaaggcagggtccctgcctagagactgagtctgagtgtagtaacatgccttaggtggcagctgatccctgtggaggtgggacaagattcatgcaacacaatcaagaatagtatttctaggttaaaaggaattaacatttttaaaaatttaaatatttttattttaagttctggggtacgtgtgcagtaatgcgcaggtttgttgcataggtaaacgtgtgccatgatgtcttgccgcacctatcacccatcacctatcacctaggtattaagcacagcatgcattagctgtttttccctaacagtctcccttcccccacctggaatcaacattttaatggttttttttaacactgccaaattgtttcttaaaaggactgtatcgagttacaaagtcaccagcaatgaatgaaagtagctgatgccccacatcctcaccagagtgagtttcatcactaagacaaagcaaaacagccggaagcagtgactcatgcctgtaatctccacactttgggaggccagcgagggcggatcacttgagctcaggagtttgagaccatcctgggcatcagacctcatgtctacaacggaaaaaagacatttagccaagcgtgttggtgtgtacctgcagttctagctccttgggaggctgaggtgttagaatggcttcagcccgggaggttgaggctgtagtgagctgagccgtgatcgtcccgctgcactccagcctggatgtcagagtgagaccctgtctcaaaaaaaaaagaaaaaaggcaaaaacttgatattttgataggcttaaattttagcctcattattttattgtatttggcgtttctttttattattagtgatgtttaacattttcccatgtttttactatcttttgtgaaaatattttattcactttaagtcttggcattgttgtttacttgctactccttttgaaaaccaacttactgaagtgaaattcacctaatgtaaattaaccatttaaaatgatcaattcagtggcattgagtacattcacaatgttgtgcaaccaacccctatatttagtttcagaacattgtcatcctcctccaaggtacccactgagcagtttctatttacccctttccttgtcccctggcaaccatcaacctactttccttttttatgcgtttgtgaactagctatttcatatagtggaatcgtaccatatgtgacattttgtgcctggcttctttcacttagcataatgttttggaggttcatccatattgtagcatgtataagtacttcattcttttttatggctgaataatattccatttcatgtatataccacaatttttttatccattcacctgtctatgggaatttgggctctttccaccttttggctattatgaataatgctgctatgatcatgcacacacatgtacttattcgagtacctattttcacttcctttagaagtagacctagaagtagtattgtgggatcatacggtaattccattttaactttctgaggaattgctaaaccattttctacagaggctgcaccattttacgttgccacccacaatgtacagagttcccattgctccacatccttgtcaatactcgtgtcttttgtgtatgtgttttttaatgatagccatcatagtgggtgtgaactggtgcttcactgtggttttgatttgcatttccataataactaatgatgttgagtactgttactatttttatataagttagaaaatgaaggataaagaaagccttgctcttgaagttattttcaaattagttaagtatcctttgaagaaaggaaatgtttacttaaaattaaatgaagtgtctactattccaaataggaggactgttaagccattatctgtttaaatatttcatcgttttcataacagagatacttgtaaagccttcaggtttatttttaacttgagcttgttttccacttctccatcacctggttggattagggatccaatctaatttacgtcttttaaacaatagcactcaaggtgaacttctggtccctgaagtttaccgatcagtattacctcagaacttagagatgtaaatcctcaggtccttcccaaatctactgagtcggaaactttgagggtgaccccaacagtctgtgctttcataagcctttcagttgagtcagatcagatgcacgcataggtttcagaaccgctactgtaaaccaacattctcagattgattctgtgataaacagctcttgtgggaggtgaaatccacaatgttggtctcattagcaccaacttttttttagcttaagtagtcagacaatatgaacaattaacttggaatcatgttataacctcctatttaagaaagcataaagcatacagttttgcctagaaattgctatttggtttacaaatcacgtaaaaaagaggaaagtatttttcaaaagcgacttttgatctttggccaaatactgaagtaatttaagaggcacatacccatgatgtatatttttcctgttatttgtaatttttcaattttttggccctgcttttcatgagctatgtttccttttattcgtaactagactttattttttacttcttcagagccaacattgtgaaggtttttagtgtgaagggctatgcggcagagcttgcaaccactactgccctatgtacaaatgttgactggagagatgtgtgtgtgtgaccctaacacatgcttatttggagaggagtgtttatttttttctctgcccaggctattcaaatggaaaaagtatacctactttgcagagttttatgtatgtacatttatgtatattagagcatgtgtggtacatgataaacattcagtaagtgttttatattattaatataattgctgtatgtaaaatttgacctttaacatagatttttttttttttttttttggtgacggagtctcactctgtcacccaggctggagtgcaatggcgcaacctcggctcactgcaagctccatctcccgggttcacgccattctcccacctcagtctcccgagtagctgggactacgagcgccccccaccactcccagctaattttttgtatttttagtagagacagggtttcaccattcacaggatggtctcgatctcctgaccttgtgatcctcccgcctcagcctcccaaagtgctgggattataggcgtaatccactgtgcctggcctaacatagaatattgtaagcattgaagcttttgcagatactatatctggatcccaaaacccaacagcatgagccatgtgctttttcaaaggcaaatcacccacaaatactgtctttcaagagtgtattcgtgaagtaactgtaggattaagtgttagatggcagaagggaaattctatgatagggcctcctaaagtcctcctgtttacagcctctaggttaggatgagggaatggttaggaatggttagtaagtgaatgtcaaaagaagaatcagaaggtttgaggaaaggttttttagggtagggggcattgaatatagactgaaggagaaaaaattaaccatatgagaagagataaatatcagataatgagagatggaatgagactgcagagtagagaggagcggctggggtaagggcaggagactggcaggctagcctggaggaggggatgcgagacatgtagagaggagtggggtgtgtgggtctcagggagcagacctgggagacaacacagttgtgttcagatatttgaaagtctgtcatgtggaggaggtatcaaactaattctcgttggtaccaggtgacaaaactcatgccagctgtaggaggaccagacctaggaccaacagaggggagaattgtctgaggacccaagcaggtgcagacataacatgaactaatctgaagaagtgatcttggttaggctacctcgttatgtttcctgccagctctgtagcactgggtgaatcatttaaatcttggagcagcagtctccttcctaacccattgcaccaggctaggggctttcctggccaagtcctagggtgacaaattagttatctgcttggctgtcctcaccttggctccccagggcaagcaccaaatcctttccttgttatatccccccactgcacacagacaggatctaaaacacaggattttgtgacacgttttacgtttcacataaaacacaaaattctggatgtgtcacatacagaattaaatctgtaaaaaacgggaataggggctgggcgcagtggctcacgtctgtaatctcagcactttgggaggccgaggcgggtggattacctgaggtcaggagtttgagacccgcctggccaacatggtgaaaccctgtctctactaaaaatacaaaaattagctgggcatggtggcacgcacctgtagtcccagctacacaggaggctgagcaggagaatcgcttgaacctgggaggcggaggttgcaatgagccgagattgtgtcactgcactctagcctgggcgacagaacgagactccgtctcaaaataataataataataataataataataataataggcatggtgcggtggctcacacctgtaatcccagcactttgggaggccaaggtgggtagatcacctgaggtcaggagttcgagaccagcctgaccaacacggagaaaccccatctctactaaaaatacaaaaaaattagctgggcgtggtagcgcatacctgtaatcctagctacttgggaggctgaggcaggagaatcacttgaacctgggaggcagaggttgcagtgagccaagatcgtgccattgcactccagcctgggcaacaagagtgaaactccgtctcaataaataaatacataaaaataaaaaaaaaagagaccagaaatacccattttgaagggttgttattagggctaaatgagataacatatgaaacaaccttgcataattcttggaacataatagacaactaataaaattagtttctttcctttctgaaaaaattagtatgtcacaaaatgattttcaaaatattgagtaactgttctagtaaacagtaatataagttgccagacacccaaaagggctcatggcaggaagaacgggggagtgaggctagattggagcctccagatgttgccaagtctatttttttgtctttaggtaaaaatgatcttaggaagagatgattctccccattgtgacgtgttcttttgttttgtttttgagacagagtctcgctgtgtcgcccaggctggagtgcagtggcacaatcttggctcactacaacctccacctcccaggttcaagagttttcctgcctcagcctcccgagtagctgggattacagatgcccaccaccacacctggctaatttttgtaattttagtagcgatggattttcaccatgttgaccaagctggtcttgaactcctgaccttaagtgatctgcctgtctcagcatcccaaaatgctgggattacaggtattagccactgcacgtggcccattgtgacctattctgatatctaatgtttgttttctagaaattctatctaatatgatctctctctctctatctaatatgatctctctctctctcttgctcctttctttttttttttttttttttgagacgaagtctcgctcttgtccccaggctggagtgcaatggcccgatcttcactcactgcaacctccacctcccgggttcaagcgattctcctgcctaagcctcctgagtagctgggattataggcatgtgccaccacgcctggctaatttttgtatttttagtagagacgggggtttcaccaagttggccaggctggtctcgaactcctgacctcaggtgatccgtccaccttggcctcccaaagtgctgagattacaggcatgaaccaccgtgcctgcccctctaatatgacttccttccaatcatttaagctaatttcctcacacacagggaaggaatctcattattatcttccaaagtggtttgtataatttttcttgaaagccattttttttcttgttgcctccatccactgttttctactattttcctttgtttgtttctttgtgttgctagtttccctatctagtgatagatagaagttgttggccaggcgcagtggctcatgcctgtaatcctagcactttgggaggctgagggaggtggattgcctgaggtcaggagtttgagaccagtcaggccaacatggtgaaaccccgtctctactaaaaatacaaaaaaattagccaggcgtggtggcgggcgcctgcaatcccagctactcgagaggctgaggcaggggaattgcttgaaccagggaggtggaggttgcagtgagccgagatcgcgccactgcactgtggcctgggtgatagagcgagactcagtctcaaaaaaaaaaaaaaaagttatttcgagggaactaattgacatcattataaatgaagattcttttaggactgtggaaagatttctagtgctttatccttgctttaaaattcaagttgtgaaacacatctttacttcctccctgttctcttagagcaattcagtgatgtttctgtgagcagattctgtagtaatcataagcagttgacaggattcgctctgctttgtgttagctaaacaatgagaacagcagatgctacaaagtaaaaataactgttaagacttttaatgtgtgtgctaaactgtacatttgggaggctctgaattgtggcaagagttttagtaacctgaaatgttttttttaagtgcttattcatttagtgcagttagtacaaactcaggtttttttggagttgtgcttgtactcaccatcatgtaattgtgaagtgaacaaatacatcactgtgtggcatctcatgtcgtaggacatgtatttgagttgacaataaatattaaatgactgtgaaagaatgatataatgccagcaaggagaagaaataccacacagagttaaattttgcatataaacgttggcaaagtgctgcagtaaattaccgttttcttcataatatgaaattcctttgcatggtgcaaaggaagacctttttaagcaaagagtaatctctggaattcagcattaagactctagttaatttcaggattttgttgttattgttgttgttgcttgttgttgctcctttgcagggaaccaaccaaaaacaaactccatccatttttactgacttaacatcaaagaaagcttgaatgtgtaagaaattccttgtgcacaacaagaggaagaaatttaaaagttaattaacatttccgttcactgtatttgttttaatttatattgtttgtaattttggaatacatctgttagttctttttgctttgtgttacctcttagtacgtcatagtaatattttctttttatcaggatagcaccataattgggtacttaatttgtttggaacctgagaatgttgttctatttatattttataatttgcataagaattcagtcctaaaactttaatatttacaaatatctatgtaatggttttacttattgatagagtgcagagaaagtatatatatttatccatatatagaaaataaagtattaaatttatatttgaaggaactctgcaaagaaatttttatattaaaaattttaagaatggaatcttctgaatttttcagagttcacaagtacatgtatacctgtagatgtaattgtagtcttagaacagtgacaattaaatgcttatctgctaaccagttagtggaacaaactggattatttccaaatgtaatcaagttactattaacttgtaatcatagcacatgctctcaagcttttataacttcctattcttaaagtaataaatatattcctgtcatactcacgcttaagcacattgaattggtgcctgggtaatactggtctaatatttctcttttggcacttaaacttaccgttctcgtgttttctccttcttcatttctttaggatgcatgtgccttttagacagcattgataatggagttaatgaaagagaatcatcaaacagtgatacagagggtgacctggcaccagagctctatctagttgctttattgaggtagtcaaagagaccatgtatgtagacaaggaggtgtcctagggtgtaggaatttttgatatggtatctcactctttgtcaaaagaaaaatcaattttccagggcagtttttgatagaagacagaatttgagcacaattctaagaataaaatgttttgcatttgaactcagattgagttcaaatacactccatgtttacaaagtaaatatggccagtttccatatttgggcacattgcttaacatgtttgagattcattttactcatctaacatatattgaagcttaccatttctcgggtgttatactgtttagttctcatctaaacttaatctttcctcctacccccttaaaaaatacattaggaagctagggcttttaaggctaataacttgctctaggttgtatagtgagtaagtggcagaataaagatttgagcccagatctctttgatgccaaatttcaagctcttaacttctaagccggtggttcccgcactttagtgtggagcagaattacctggaaagcatacattgctgggacttagagtttctgattctacaatagggctcaagaatttgtattatttctattatttttttttaatcattttagtttttttttagagacagggtcttgctctgttgcccaggctggaattcagtggtgcgatcatggctcactgcagccttgaactcctgggctcaggtgatgctcccatcttggcttcccagagtgcggagattacaggcatgagccacaatgcctggctaattttttatttttttagagacagggtctcactgtgtcgcccaggctggtcttgaactcctggtctcagccatcctcctgcctcagcctcccaaagtgttggaattacaggcgtgagccacggtgcccaaccagaatttgtatttgtaacaaggtcccagatgtttatgctgctgtttctgggaactatattctaagaaccacagttctatgctgtgctgcctgacttgattcctctgagggataaatgagagaattcacatgtgcttgtgttaataatcactgacatttattgactacttataatgtcctggatgctcttccaagttaattcctttttatcctgagtttattttaggagctagttaaattgcagggagagtacgtgaggttatactcactacttcaaagagaaggaaactgaagtaggaagaggtgcccagtaagtggtctcacagtgagtcagtggtagagcaggttaccctcattattgcttctgtctgctgagctggtttggaaggccagtgtcttctttggagccatctccagaaggagagatttcgtgctataggaaggttgaaagaaaagtagacccttcctttcatctactggtgttttttgtccttggaggactattgcagagcaggcctggaaaaaaagaattttcctcctttttatatcattcttgagcattctgaagggtggatgatgtactttgttattctgatgaatgatgtgattctgaaaatgacctatatttcagttgaactgtgagatctttggataaaagggattccaggagattttgtatgtaagaaccatgctagtggtgctagtgcattaaattagaaaatgtgttgactgatggtggccacactccagcaaggcatctgtggtgttaacctgcccatggccgctccagtagccaaggaaaatctcaaaagcaaaatgcaagagagtgagaaaaaaaaaatctattgtaattaagtctgaaacctgtactctgcttaggaaactgtgtggtttcttcattagttttaaagagaaaaatcctacagagaaagcgtcttaaagaaaaaaatggtcttaagagagagtataaagcaatttcagaaggtgagatcacattgatatatgaatgaatacttggtgtatttggttcagttaaaaattttgttgagtgactgttatgtacaagatacttataaaaaaaatttgtccttcctctcaaggagaacttatagtagccttcacagttgaatgtttagttaatttataaatgggcatccagtctgaaattagtgtaacctgatgtggatcttgtctccatgctactgataggattttcatgataccagtatttgaatcttgggacacatttttctttttaatggggtatctgtttcactgcagagctagagctagatcccaagcttcctcactctcagcttggcgttctccctgatttaggatgcctttatttatttagtgtatagatttatctccaaatattaagcagtgaactttcaaaagggtattacgacttgtcctacttttttggatatatacatctgtattttatccttggtttttttttttctttaagattttaaatgcaacctagacacttgtggttagggtgctgaattttgacatatgcggtttgacggaaagaatcactggtgtgtcaattctggtttgttgtaggttaacgaagcccttgtcatttgctgattgtgttggggatgagctgccgtggggatgggaagcagggtttgaccctcagattggtgtctactacatcgatcacatcaacagtaagttttcctttttggtaaaagcaaacatatcagaaaagtaatcccccaaaacctacagtcacacaaaagaataaacatgttacaaagtgaatttccaaaaccccattttcttagtgactaatatttaactgaagtgcctgtcttggtatttggggcatgtacatagagttgtccttatgggggcggagagggagaaagggtatctggcccgtgtgcctgcctgcctgcctgcctgctggggaatgaggattctccttcagcacaggtctgggaacctgtggggatcagagctgctgggctcctctttccatggccactgcaccttctgacaggctcttcctttccttgtgtttgccacagaaagacttgggcgttggcacaatgtggtttgtaggctgggactggggaggggttggcctgcatcagtggctctggaagacatagcgtagctgggaaaggtcctaaacctcttccttttttctgtttcctgatttctttgtcgttggaagggaaaaacctctcattttaacagctcttaaatctgtcatatctctgacatggtcagtctagggcagaggattactgtggccgtgaatgactttcaaaaacacatactttgaaatattttttatatatttgtgtatgtttgtgtgtgtgtgtttatatgaatatctagcactctatctactcctttaaaaatgtattcagatggtagcatacaatactcattcactttgcttattcacttaaaaataattattttatttttataagttttgcggaatacataatgaatttattcctcattgtcttatttcttttagatctattcttatatttaaaatttgtatatgtagtactctgtagtatctttaggaacagtatcactgtagcaaagtgtttcatttgatactcactcattagtgatggcttgcagctgcccttgtgtaggtagatgatgtatttctcaagaggccaaaaaagcctgtattattagctgtgaggcaccatcttccaggcgggtgaggtggaagggcagaaaggagcgtaagcactctgaagtccagtgagcacatatggttagtgatctgtttcagtagaacacctgtcatacacagcttgggaaccagctttcatgtatactgtacattattagttcaacacaaatacaaataatagtttctacaagttgttacctcagcctcttttatatgatcagaagaaatgcgacttttttgtagagctattatttatctctccctgaaagtttctgaaagttctatgaagaatcaatgattgtgtttttaagttagcttttaatttttctaataaatgtttattgatatactgtattagtatataccaggttttattgtgtatcagtcactgacaaccaaatgtcatctgtaagggtgaaatgaactaattttgataaaattcagttcactttaagcacggtgtctcacccttatgtcattgcaaataaacaagtcagtgaaatatctgaaatgtattaactatttaactctcacttttatgcttattttagatgaataattgtgtagctttctttccttaaagtagtatttgggaaaccagaaaccaacctcgccatcctgggtcaacaaaaataagctctgttggtaccaaaatgagaaaagaaatcctcttagcctccttctcaacacctacaaactctttggtatctaaacccaccttcagggcttcctcctctttctcagtgaaggaggcattcctctggacacctccacccctacagatacctcttaataacttttctatttcatcattctctcctgtttggtatctttactagttatttcctgattttaaaatgttctcccaccatttctattaataaatgattcttttgtcttaatgtataaacactggaaactctcaaaacaaaaccaaaactgcaaaagaaatacaaacagatggcattaaactccctttcgtcaccctctcaaaaccatccttcaaccagaatcccttgccaactgtggttgcctcctcttcccttcacagccagacttgctgaaagctgtagtctgcaagaactccacttcctccattgttctccaccatctcacagaacctgttcttgctgagggcacccgagaccccacgatgtagtttggatatttgtcccatctaaatctcatgctgaaatgtaatctccagtgttggaggtagggcctgatgggaggtgattggatcgtgggagtggatttctcctggtttagtgccatccccttggtgctgtctttgctgcagtgagttctcacgagatctgtctgtttgaaggtgtgaagcatcttccgcttactctcttgcttcctctctcaccacataatgtggtgctcccgctttgccttccgccaagagtaaaagttccctgaggcctccccaggagcccagtagacactggggccgtgcttgtatatcctgcagaaccgtgagttaattaaacctcttttcttcataaattactcagtctcaggtattcctttataacaaggcaagaagggtctaatacaccctacaaactatcaaatccaaacaacactgtagtcttgtctctgtgacttgccactgtgagttattccctcctgctctttactctttggattttgtgacatactgttcacatacgtgaccacacctgcccagctttcttttgcctctttcttcttcaccgggacctgctgtcaggatttctgtaatagtctttagtcttctgctgtttgcatgctgcagatctccttgggtgataacttcagttacttccttcagactgctggctgccacatctgtctaagtctttcccagagtccagatgcatgtgttctattccttgctagaaggctcttcctagtctgcttgcaccggcctctcctttttcatctcctgccctgcctggcactggaggcctttaggaggaccctgtgcctcctcagctggctgcctttctttgcatctgtagagtctagcctgagcactctctgcacagcccctaggccctccctttgtctgaaggccacatccttctaggggcagtctgctcaggtgccactgcttcccacaggccttctctgatacccacccctccacctcacaggtccccgtcccattctggtcgagtgccccatccagatatttccagaggaccaggtgcatagggatttttttaaaaagcattttcatattgcatttatattattttttgtatgttttcctcactaaattgtgagcttcttaagggcaatgactgcatcttttatgttttcatcgctgggcaactagtataatgataaactcttaaaatgttaaaaagaagagctttattgcttaactcagcaatcaaaagctttctgttatttaaaggaattaaagtacatttcaagtataaattatgtgtcaaaaaacaccattttgaatattttaaaacttcactattagaatataaaattttaagtctgctattttgctgtaatggtaatggtattctggtgatctgttgtacccaaatgaccgacagcaaacagttcacccactgaaaacgatctggtccattgtctcattaatcttcaagacattcctgtgaagtagtttaggaagcaaatggtattatcttctcaaacagctgttccacacatatgttgtgttctgacatcgtatagtttcagcatcattttctcattatttaaataaaaaatgaaataaggaatgtttggctgtttaacactatttctaagaaacactattgaatatttagaagtaaaagatttgaccttgactgtgaaagttattttaggccatcagtgttgtatgatcatattcaccttccagtgggtatatgtggagtgggggtgtagatatcagtgagggatgtttgcagctaactagaaggtaaataaggaggtatggtttataaggttttgatattattaatacaaccagaagtaaatcactttttggtagagtcagagttgtactgtaattttttttcttttagtaatcaaggtttcatttacatacacaaaaatgcactgattttaagcgtgtattttgggtggactttgacgtatgtatagtcctttgtaacttgcccccgcatcaaggtacaaactttgtccgtcaccctggtaagttctgtcctgcccctttccagtcagccctccctactgcggcagacattgttctgatttctatcaccatagcttagttttgtctgttctggaacttcatgtaaaaggattgtgttcagttttgggaatagattctttcagcgtgttttgcagtttgcacctgtagtcccaactacttgggaggcagtttgcacctgtggtcgcacctacttgggaggctgaggtgggcagattgctggagcctaggagttcaaggctgcaatgcgctgtgatcacaccactgcactccagcctggttgacagagtgagaccctgtctcaagaacaaacaaacgaaaagtaatggtatataggagaaaagtagaaaatatagataaatgaaaagaagaaaaattatctatgttcatacaacccagagttaactaagtattctaaatcttctgacgtgtatccttccagactttttcatattgatacacacatgcacatatacacagtttcttaaaatttatttttgttttcattttttgggggtagagatggcatctctctgtgttgcccagactggtcttaaatctgacctcaaggaatctccccacctcacacacagctttaaatgtattttacatcgcaaatgggattatattatatatactgttttataaactttttcatttaatgtataattttcaccaaaaaattttttgcaccatgatatcaattcttttgataatagaacttcacatttctgtcagatgattttcatagaatatagtcaagattctttgaagctgagcatggtagctcttgcttgtagtcccagctactcaggagggtgaggtgggaagatcgctagagcctaagagctcaaggccagtcttggtaacatataagacctcgtctctttaaaaaaaaaaaaaaaaaaaaaaaaaaggttccttttgtgctcttgcataaaacccttttgtggcacattactgctttcaaaatgagtttcatattcatttactggacattcaagagatcataggctagtccttcttggggtattggtaaagaaatgagaatgtgtagtgaaataaggaaaggaccaccaccatgccaggagaagatggggaaacatgaagaagcagcctttccattctaaagagtgtagccacatctacttggagaaagtgctttaagctgaaaccaaagagatgactgagttaaccaggctggagaaaaagacggtggggaagaaggaggaccacaagtagattcaaaggtctcaagaagcaggacttgaggaaagcaggacttgaggaaagacatgcaggaaattcagtgcagctgaaggctggtgtgactggggtaaccgggggttttgactggggcagggaacgggccaggttcttttgtcgggaatctttcaaagccctctttaattaagcctgttccacggaactgtactcttttcagccagaagaaacgcatttgtctctaaactgccatggtactagccactcatacactagccatgcacatagccattctccgctcaaggcattaattgtgttctgcgtacatctatgtcactatttcttctacattttgtaagtttcttggaaggagggatcatgcccgattatcttatttttccaaaccctgtagtagatggccaataattgtctgtagaaattaacgaacaaataataaatgaatatagcagatactttataaaaaggaagataaggaaagttacttatattcatttgatttattcttcctaagcacagtaggaagaacagaaatatgcattatagacaaaaaaaatcttctttgaagaatctaatgttatcttccatgataagctcttgtaattcacatgtgttctctacctataaagtttcacatctataaaactgatggaatgtgaattcccttgaggtacagggcattttgacagtattatatattgcttctttaatatagtagaaaacagcaaattatattataatgccatgagctcccaaggccactgggtcttaataaaaaataccacatttgtgtaatatacttgagtatttacatttaaaaaataatcttcacaaatctattctgcaaatacaacgatggagatgaagcaccatcctgctttatgaagccttctaaggtggctttgggaaccctcttttgtagttcatatttgaattgtgcagtatttcagaaatgagaatgcttcccactgactctcttgtaatatgcggtgtttaaaccagtctactggagtgtttttcctgacctatccaagacaaatgctgatagtttattatcatcatcattattgccctttattcatttaagtgtcagtcagtgtttcgtggcattttagccagtgacaagtattttattgaaatataccgtgtccccaagatggagggaaatatgattggctgaaacctcaaaagattgagagagaactgagagtacatatcttataattattataacttaagaacatttcagatttttaacatacatttttaatttttattatctctttattagtttattaattatatatctcattgtcacaaattgttccaaaacttagtggtttaaaataatatttattatctcatggtttctgtgggccatgaatctaggcaagacttagctggatactctggctcaaggtctctgtggtagtttgcaatcaaggtgtcagccaggctgcagtcatctcaaggctgactggagaaagatttgcttccaagccactcgtacggttgttggcaggattcacttccttgctggctgctggccacaggcctccctcattccatgccacgtgggcctctccacaggacagctcacaacggggcagcttgctttgttagagccaaaaagccaagaagaatcagggagagagagagtgagcaggacaacagcacagtcttttgtaacctaatctcagaagtaatatcttgtcacttattctatgttctgttcattagaagcaagccatcagatctagcgcatactcaagaggcataaattactaggagatgaggattattgggagtcatctacagttctgaaaacttttgaagaccacacatttatgttcgttagaggatgaattctgtactttgaggcaggttgcactcacatatataaatattggaaatagatataggtattaaatattaggatattcagagacctgagttataatgaatatttgaacctgagaagtttggactcttattgactgatctctgcccatctcccacattctccagatggctgggctgccttgtggtggtgatgtccttgaagattcttggctggagggtctgtccatcctgtacatctcttgtttagacatcagctctagcatacagtttgtttgttttttttcacagttaggtgagatatacatcttctgcatatttaaatatttacatctttaaaattagtgtttaaaatactactttagagaaagctcaactttagccagtgagtgtgaggcaagagctctaggtctaaagcagtggttgcactgtgcccgtccgactcaggccattttgttgatcacccagggcttctcttggcctcaaaaggacccagccttcacagcctgaatcactttagcttagagtcatcccttatccctagaggccaggttaaacacccacagaaccagtctggtctctggaaattcctgtgggccaagtcagatgccctctgacttattaacgaacaaataacaaataaatatagcagattattctctaggttttgacttgctgtagctcttggggccaaccagaaatacttcgttgggctgcattaagattgagattaccaggcaaagctttttgaagacagtatatgcccctgggcattccagaaaattgatagtatttctattctaatctatcaggaacaggttcttacgttcatatagtggccagccccatggcccatcttgttttgattatacccaggatttaatttatagaggtgactgagtgatgatgggaagaggtcagtgccattgaaagaagttttattatagttctcaagggaagggggcatactacaccattctgggccacatagtggggaagcgcttgggttggttggaaggcagaaggagcagaggagaaatcatggcccagagcctgtattgtggtttcctggggaaggaatgagtgaggcagggtaggcaaatctgagcaagtttaggattggctaggttgaataatttcggcagactctgggttatgggaatggtctctagttgtccagtatcttctctggggggtggtgtagggcaggggaaatattggtttggagtctgagttagataaaagaggaggttagggatatgggcttttggactgttggtttacatatgaaggatgggctcatgggagtcatttgctatctctaagaattaaattagccctgggaggggcagtctcttcccagacagcaaggcccccaagacatcaaagcatcataaaatatataaaattttaaaaaatgatcaatacaccatccactgacaaatggaaagtgcaacattatgtgtcatactaagaaactttgagaagaaatattttcttgattgtttttcggtctcatctgctgatctgcccctgacatcttgtataaatacatatgtggtggagtgtgcaaattccactaaaggaagagggagcagagtggatataattttataatttattaagttacaagtctcttttttctccggtgttgctgccatgtgcacagattgaggggaagtgttgagcatatgtatatataattcatttgttacagctgactctatcccattttcatcagctggttcaagccagggtaggttaacatgggtgcagagtgatctgtggagccttagttctagacacagatgctctctggagtcaaggctggggaaaggaatgtgactttataatttctttgcttttgcaatctgagtatcagagacagtgttatagcttactagcgttaaaggctttttatattttgcagtatctcatttaatcttccaaacagccccctgaattagctccattttattaaggaggaaattgaaccctggaaaggtttaagaacctgctcaaggtcacacaatttgtaaatgacacacctgaatttgaacccagttagactgaatacagggtttatgatcttaactactgggatattacatctcagttcttttttccagtattcgtattcttataacttcctcaggactcaaaataattcatttgctttttttttttttttaaactttcattatgacctgagtctcagtattctcaatgtacattccaatatggaatcattttaattattcaggtattaggtggaaggaagagttatccctccttttcctgtttagtttttcacaatgcgggtacctcagcccttctgaggtacccgcattatcacccaggtggtagtgctaccatatcattttgtttttttcttcttcctcctgcacctctgtacctcctcatccccttctagtaataagtgctgaggttcttattggaacactttccttttatatgttccatagtccttctgtatccactcctttcatttccagtgtggcctgggctgactaatgtacactctctacacccctaagaaaggggttgtggaactctgagtgggctgtggaagtattttcaggtatgatatgacatcaagggcttaaaatctaagagtactgttactaatggtacacaaaaatgattttattgagtcagttaggctgtgccttaatctaattttgtttttacaataaccagagctgcgtatttattcagttctctagtagaatcttagaaaacaattgctagaacttgccgttacatttctctattaatgacaggtttattttccttttttgttttcaagagcgattcttcctctcatttctcccctgccttgcccatacacacagtgttactaagagccgccatcacaggagggtatgagtagtacagtccaagaccaaacttcttcagtttccatttgcatagattatacaagggtatgttgggttgagttctctcagaagcaaaccctaagccaagaatttaagtgaaagtggtttatgaaggaaatcccaggataaaccagtaaggaaatgaggaaagaaagaaagtggagggaaaaaaacagctgaaggttttatttctgcaaagtctctgactccacatgattgtggtggctctaaagtacaatttctacctcagagtttgccctacctgggagttctttctgtcttcttcacttgtcagtcattggctgcaggtgagttagcgaagtgctctagagcagtcagacatccatcaacaacaaacagcaggctgtggcagaaagacccgagaataccaggataggacaccaacagtgtctgctacaaaggctgcatcagaaaatattcgtccatatttcagcctctttttacaatcgagagacatgagagtaagagaggtaaaatacttagagtctcacatctggctaggtggatatggaacccacacggccttactccctaaccagtgctcttttcaacagctggtagtggcaaaggattttattgctgttccattatacctcatttctctttatcagtcatcatcagtcattcatttgaaccttgtaaagcatattttaataataaactgtaaatcagctttattattatatacaaatacataaattgcatctattttcactatacaattcatgagttttgacaggtgtataccatgtaactatcacaataatcaagatagggaacatttccatcccctcaaaaagagctttcttcttgctctgttgtaacaagtacttctcagtactgctgggcccaggcaatcactttctgtcattggattggctttacttttgcccgaatttcatataaatggaatcatacagcatgtggtcttttgtgtctggcatcttttcactcaacatgtgtttgagagtcttatatattgctgttgagtattttgtttcattttattgctgagtagtattttattgtatggatataccacagtttgcttagccattacctgtaatagttttgtctattatgaataaagctgctaatgagcatttgtttagaggtctttttgtagatacatattttcatatctcttgggtaaataacaagttgtaggattgctaggttgtatggtaattgctaagttgttctccaaagtgattggaccattttagattcccggtagcaatgaatgagaattccaattgcaccacatcctcttcaacacttggcattgccagtttttaaattctagccattttacatagtgagcaatggtatcccattatagttttgacttgtatttcgctgataattagtgatgttgagtctcctttcatctgcttactggctatttgcacaatagtcagtagatgtgcaggtttatttttggactctattctgttgcaacatagctgttttatctagattatgcttattccatcctttctacatttcgagatctgtttctattgactgatttttctccagattatgggccatatttttgtgctttttatgttggtaacattatagtggatgctagacattataaagttggttttgttgttgttgttttcattgagtgctaggttttgtgccttttagggagttttatattttttttcttctgaccggcagttaagttacttgctgaccagcttggtcttttagaagcttgtttcaaagctttgttaggttaggttcagagtagcctttaccctatgtcttatttagctctgttgttaaggtgtaactttgctgtggtctccactggattccctagatgttcactgtggcctttctcctctggctggtcataatttgaaactgtcacagccctgtgtgagctcggggaatttatctgcctatagcgtcccagttgtcctttgcctggccttgtgcatttcccgttgtcatctcagcattcactcacagacttcttgtgacccctgtgcaaatttctggaacttctccagtctctggagcttctactgtgctttgctttacaaattccacctgtcatggcttccgtgaaatctgcttccctctccctgcaattcagcagtgcctcctttctctgcttgagttacccctctttgcactgctgtccaaaaagtgctttcagacagaaatgtagggtaatcgtggggttcatttcccttctctcagagatcacaatcctgtactacctgttgtccaacatctgaaaaccattgttcatatattttatcttctagttacagtggccctgttattccaccatggccttctttgtgttttgctttgttttttaaaaatctctattaaccttttgtgtatcaagcttcatgtgttttctgtattaaagccatacttctttttgtcccaaattatcccctgtttgtgtttgctgttgttgggagtggggtccactcggatacaatatcctgctagagacgagatcttaagtcacaataccatagtttttatgcctttgaactattccacttttattttaaaacatgtattactgaatactacacacagaaaagtgcatagactgaaataacatagtttaacaaatattttagaagtgaactgtgtaatttcgatgggtgaaagaaatagaacatcagcatccaggaaacctcttttatttactctgtcccattctcaaccccttcctctactggcaaatggccactctcctttctttcacagcagaggggtccagtacatgtctgcagacacagggggatagctcttaaccagcctgcactaaccatcaccaaaactgtccgttctcttgtatacaccatggtatcccaatgctggacagcagtacactccaactccttggcccaacatgtggtcaaaaaatatgttaattttaaaatgtgagaacataaaatgtttagggtaatctgattctttcatttttgtttttcttcatgttttgtggcccctactgtagcttcaccacacagtaaagaatgtgtttggagtttataaactgagcataagctgccatggaagacagaggataaagggctgacttgcagatgaggtggctggggcaccttctggaggaggcagcatgtgaatgctgttgcagaacactggttcttgggctcggctgctcaatggaatcacctgagcagctttgaaatctaccgtgcctgggttgcatccacagaaactctagttggtctgggttttttttttttaaaagggtctctggttgattgtagtttgtggaagtgcagaagcaagaaccagggccttaggctagagcattctgtataaacaggaccagggttctgtttgtttgtttatttttaaatttcagatccactgcggactcactgatatttttgtaaaatacaagaaaaagtgaattactggaaaagtgaaaatgtatacacacaaagaaatgcatagtatttatcaacagataaacaataactgactaaaatcgctataatgattacaaaatgttttctatttctgtcattactgttgcggacataaaactgagttcatggactggtgttggtctgcagagtagaccaactttgattagtgctgatgcagagggcagtgtgtctacagtcctgtattaggtgaatgaaggtgggttgggtccagcttatgcagggcattgagtgctggaatgaatagcttggcttttattctgtaggcactggggagccacagaattcttgaatgatctgattgacaacattgtgtgtggtagatttatagtgagaatacactgttgatcagaacctggaagaggaaggaagttgatgagactgggtaaaataaaactaaaatttctggagaagtcactccagcacagctaaataaactccttagaggatacaagaacttaagctagcctactccctaaagcttaaacaagccggaaaacaaagttaaattctaaaaagtaccctccacctaatgttttcagaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagctgtaagtacagtgtggctattcagactttggaagtggagactgaattgtagataacagaagaccacttacatttctatggagtttaattttgagtccttttccctcctaagcaggaagagtctctcaaaaccattgagaggtgagggcacaccccagattttctcacccctacttcagataaaagaatccctgtttgggggttatgcatgccttctgtttctgcacctgcctctgccaggttgccttttatgcatttacgagttaatttttaccttttcagaacagtgcaagtagtttggccctttttgctacttttgtacaatatttttagtggggaggaactggaactattacctagagtgtaatttctgttgaccatctgagttgatttactgctccctcatctcacagattgactatttggagctggctttgtttaaagaagcagctgtgatgagctcagaagttctgcttaaattataaattccttgataatgcaaaactctgatatactgctgcagtatagtcctctgaggacatagtgtgtataaaatccagaagaaaattaagcaccaaggtcttaatgacatttctctttacagagttaaaaaaaatggtagaggtttgaagataactttttatatttaggtgtctgatcaatggcaataaaggaattagaaagcaagtattcacagaagcacataaatcttgtttttagcttcagtaaattctaagctgagaactagttatgcaacttgtaaataattagtttttcttttttctctataaaagtattctcaggatcttcatccagtactaaatatgatcccgatattttaaaagctgagatctccactacaagattaagggtaagaagttttaaattgtggttctatgttgacccatatgcatagagtctgaaggctgtggaaggggctttagtgatcagttctcatctccatttggtgtagaaaactcctccccttatctctgatgagtggtccttctaccttgatgtgaacaagttcagagtgtgggatagtctttattattgagacaatgtgttccactattgggtagtgttttgtttgtttgtttgtttgtttttttgagatgaagtctcactctgtcacccaggctagcgcactgcaatctccgcctcctgggttcaagcaattctcccgcctcagcctccagagtagctgggattacaggcgcgtgccactatgcacaactaattttagtatttttagtagagatggggtttcaccatgttggccaggctggtcacattggtcttgaactcctgactgcaagttatctgcccgccttagcctcccaaagtgctgggattataggtgtgagtcactgcgcctggcctattgggcagttttattgttagcagttagaatattgaatcaaaatttgagtcttgtaacttgctttccctcattgtgctgagttttgtcctccagagttaagccaagttgctgttttgtcagacaacccaatatttcaagatgcccacaacttaaaagtctaagtcagactttactaggtgctcataatgcctcatggagaggtgtttcctgaatcttggcctgaatctttttaactaaactgatgttaaggccagaacttgtttatccttgatttttagaatattgaagtctgttcaccaagtaaataaactcatgtaaccaataccccctggtcatgaactaggttattaccgtgatttctcctcattagttcacctctccattaaggtggtactagcctcatgagcactgagggttaatttttcacctgctttgaacttcctaagactggataccgtatgtgttaatttgatggctcgccttgctcaacagcatttcgagatccacgttcatttttgttgctgtatagtgttccacttttgtgtacataccataaattctttatctcgtaatattgatgtacattaaagtttatttcaatttctgattattaaaaattatgccttaatgtacatatctattatgcattatatgtggaacacttatatgttgacccttaaaaggagatcaaatatactgagatagagaataaaacagtggttaccgtggacctcgggggtggggcggaggtgaggggagatgaaatggtgaggtgtggttcaaaggataaaaggtgcagatatgtgggatgaacaagtctagagatggaatgtacaacatgaggactatagggaataacattgtattgtattaggattcttgttaaataagttaaataagtagattttgtgacaaaaaatggtaactgtgtgagctgatggatatgttaatttgattcactatagtaatcattttactatctccatgtatgccataacatcatgttgtaagcctcaaatatacacaatacaatttatttaaaaaaatacaaccatggctcacttaacaacgggtatacattctgagaagtgtattgttaggcaattcccttgtcctgtgaacatcacagagtatactaatgcaagcccgtatcatagggctactacacacctcagctatatgggatagcctattgcttccaggctacaaacctgtaccgtatgatactgtactgagtactggaagtacatattgtaagtacattcagtacctagaattataacacacagtggtatttgtgtctaaacttatccaatggtagaaaaggcagtgcgagacataccgtcttatatgcagggaaatgtggacatgtggcacctgactgtacatatctcagtggatactgccagtttcagcccttcttacttgcttatgtctgcactaagtctctaagttactttatgcacaggcttttgcctacatctcacaagttttgaattttatatttccattgttattcagatcaaagtattttctaacttcctttatgatttctcatatgagtgcattgcttaattttcaaacaattggagattttcttttattattgacatcaacttaaatacattgtatttttcagttcaaaaacttatatttgaacctgggtgcagtggcttacacctgtaatcccagcactttaggaggccaaggtgggaggatcgcttgatgccagatgttcaagaccagcctgggcatcataacgagacataatctctattaaaattaaaaaaagttttaatctcagaatttctatttgattatttttcaattgtttctagttacttgcccaaattctgcacattaatgtgtaatttttgaacactttgtcatcctagagaggatttagttttgtttgttttaggtagtcaggccagggtcaggtaattttaatataatcatgatttgagctgactgtagcctgggcttcagtccttctctaagggcgggtcaatttccagtttcccttttcttttagggcaaagctcttcaaaatcccagttgaactcttgaggtgttttaccagggccccttccgttcgatagatgctgaacttcacgtctcttccctatgccttagctctgtgcagctgccagcccttctctgtgtctcaggtgctcagtcactgcatgctcccagcctttcactttctctgttgtgtgggcaaatacctcaaaagcagaaacagtgcgatgtttggattatgacactgagcttcccttatcttttggattttttttttttttggcggagtcttgctctgtttcccaggctggagtacagtggcgctatctcagctcactgcaagctccgcttcctgggttcaggggattcttctgcctcagcttttggagtagctgggactacaggcacctgccaccacgcccggctaattttttgtatttttggtagagatggggtttcgccatgttggccaggctggtttcgaacacctgacctcataatctgcccacctcagcctcccaaagtgctgggattacaggtgtaagccacggcgcccggcctcttttggatctttaacacaagttcttgctgccttagtcctcgaatgtcctcaaatagatgtatgtgtttgttttctcataatttttctatttctttttagaaaaagagtatgaaaaaggtttgtctacacttactggaagcaaacctctttagtttggatttctttatttatgaagtcatcattctatgtcactgtacaataaataccactccagggtgtcctggaccctttactttgtcagtccatccataattctctgttcttgcaatggtttgtcaaatgccttggtactgtatctctgtaccgtgtctatatgtttgtttctgtgatctactaggctagataccttatcttacaaaaaaggaaatgaagacatttttgtcaaaacttactctcaataaactccaatactcgagctgtgcacttctcagcaagttattattacttccctctgaaattttcacccttttcatagttcttatccttgcaagacacactgtaaatggaataaccacaataagctgttaatctgtatacttagatccgctaagaaatatgcaaactgagggagagatttagaaacaaaaatatattaggatatctcataaaactaaccatttagaaggaaatggagcctcatcccaatcaggggtagcacaggaaatcccaagtggtcacattccccagaattgtcttctaatgtagcggaatctcttagattaagcttcttctatgccaggtttagttcgctcttaatatcagaggcctatattatattataacgtataatatatataatatttatcaccttgtgaccacaaagatgagtcggagagagacgccctcttcaagaaggtgcttccctcacaaaaagaagacaagatattcatacataactataataaaagatcagaaatgacactggcttcatccctttcattagtgcctaggtgcttgtttaatacttcctggcactgtgaatgcctttttagaaatgctgccatagcagattggtcctcacagactgtgttgctgttgtgatgttttgagctgtgtttgaacacttgggcacagatggtgcgctgtttggtatctgtgtccgttttgaccaggtagcactttaggaatggcccagccattcagaagtggatgggtaacttggcagagtctgttagattttgataatctggcccttcttggtttgcgtactctgttaaaaatccctttcacgaattaatgccgtaggagtagtaactcttgaataaattaactcatcactttggtgttttggaagacttgcctgcatttttggtcacaataacaatttttaaagcaaagccaaacgctagttttatgctttaatgttttgttgcaacaatattagcaggtgtacctcagttgttttactgaattagtactagtaggtcaagtatttgggaatcatgtatttagaagcacctgtctaaaatatatttcatgttatgttatggacataggtactgataatcattgggcttgtttcctctttggtcaaatgggataacagtacttcccgataccttatttttatttgtcaaaatggtaaaatgaatgcattagtgctttttattaagatactcttaacttttaaagctggtgtttaattgcttgagaaaatctcaatagccattttttaaggaagaagaatataaacgttttactgcaaaatttattatttatttagaatagatcttagaccatagtcaccttgggttaaaatataaactgtctcatgcaaattaaactttaaattcaattgccgttaaaaaaaaaaaaacacaataccgaagtttataaataggtgaaatttggtgaaaattttgtggagaaagtttttggctaatttttattacatttttactattgttaagcctaaatagagtgttagaaatgtaaaagaaagtctttagaaatactaatgtatttgagaagtgtattgagtacccattgcatgtgctttaatacaacttttaattttgtgagagtgaagaacaaagacccctttggttaaactatttgcaccgcattccaaacacatagctggctagggggcactgttattaataacagtatactatcttttgttctcaagtatgtactgctcacacattgttaatatagactcactttgaattcgttttagcagtggtgatgagcttagaaaagtcatccacagtcttagctatttgtaatcttggagacagatttaaaagaatggcagtcaaatttaaggttcagtttgtaactgtgagtaaagtaataatgtgcacatcaaaatatgacactttagctaattatctcacacagcaaaaatcatatcagtattcttcaaataaaaagaaatatgctggccaggcacggtggctcatgcctgtaatcccagcactttgggaggtcgaggtgggcggatcacctgaggtcgggagttcgagaccagcctgaccaacatggagaaaccccgtctctactaaaaatacaaaattagccaggtgtggtggcacatgcccgtaatcccagctactagggaggctgaggcaggagaatctcttgaacgtgggaggtggaggttgcggtgagccgagattgcaccagcctgggcaacaagagcgaaactccgtctcaaaaaaaaaaaagaaatatgcctttggagaatgtaaattgccgcaaatattctctcttgactagacatgagagatatccttattctcatactgtgtttacaatttagcttacatttcaagttctttcagctgtgactttgctttcttttagggtgttgaaagagaatgatgctaacttgtaacaccaaactgtagataaggttattcttaggatatttggaaatgaatttgtattgtacagtagctcccctttattcatagggcatatggtccaggccccccagtggatgcctgaagccccagatagtactgaacccattgtatactgttttctcctatacagccatacctgtgataaagtttaacttataaattagacatagtaagggattacgacaatgactaataataaattgaacagtcatcgcattatactttaataaaagttatgtggatgtggtctctctctctctctcaaaatatcttattgtatcatagtcatctatttttggaccgcagttgactgcaggcaacctaaactgcagaaaatgaaactgtggataagggaggactattatagttagtgttgggttagaaaatagtgcaacagtcttagtgaattttgagtgaaattaggaatgagatgacttgacttacattcgcaagaaaaaaaaaagcaagacagaaagaaaatgagagattctctttaatacaggaactagtgttatctaatatgacatgctagtaacttgaaataattaaaatgtatagcacagtagtgtcttctttcaaaagcataccagaatttgagtagagtgaactttaatacttaatcacatttattgattttataatgttttatttctctcactctctatgagtttggcctccttttctagctttgaagggtatgaaactgcaggctaaatatgtattttaaaaaagaaatcattcactggcactgtgttgttgaggaggagatatttagtttctcttcacctagctaagctaccatgtcaatctatatacatcctaattcttaaatgcccttatatccataatgcttgtggcattttacaatattaaaagcaattaatttttcctgttagagaatatataatctgagcaaacaggattgacaggaaaatatcactcataaatgatctattttaaatgattctataaagcctacaaagctcatttgctcatattttgaaggtcatagggtctaagctttgtggaatgttatgagataaagatataatgaatacattcaaaccaacacttccttatattttggtacttttctttgacatgtacgcaataaatacattgacctaacatgttcacactgaattttgaaacaacctcctgatgccatgacagtgaaagtatgaaatagctatttattgtacatacgttttgcaatcttcagcagcctcgggtgcacatttatttctagagctgagggtggtagacataatactctcagcttctacttaatgaaggcatcagaattttagctccttcaagatgtaagggaataaaattgtgtgattcaagagtcgtcagctggatgacaattttagatgtgtctttagagagaaggtgatattggtgaaataggctcaacaagaagacattttgcctaaaattcaggctgtcaaaatcatgtggatatattttaaaagatccagcttacttctgtttctgtccatgaaagattaactaccacaagaattgccctctaacagcaggtgattagagaactggacaaaaatctaggaaacagctgttttcagacttcaggtaacagtagaagactgtaattcttaactgaaaggaaacagatgaagtgagccctgggattgcactgtttgcagtatgaggagaaggacccaaacatagtctagtggtgtgcatgagttgatgagacagaagagaaaagttcattggcggagaagtggctagaatatataggaaataccagagagaagggagctacagagatagaagagagcaagagcaggcaagtgccagtctagagatttctagtagggtctcctcaaatctttgactgaatactgattgagtagccatggtacacaataccatgaggctggagaaagaaagtgatagggcagttctcagagctcacatagggctgggaatagtttgtgtttccatcagccagcatagagacatagaaccttgaacagaaacatcagaagggtaatgccatagtagtgggaccaaattagtctgaggctagtgctgcattggacttcttctaacaaaaattgaaagcaaacattgaaaggatcaaattgatttaaaataatttatttgtgtgctagaacaaagtccaggatcctttaagataatacagtaaaatccagcaccaagaatgtaaaattcacaatggccagtatctagtcagaatttttcatgtgtattggggatgagagtagtgtggaggggcaaaagagggcttaccaagagggcatcaggaaacctttgggagtgttgggtatattctaaaagtgtattgacagttacatgtgtatatacatgtgtcaacacttatgtatgtagtttaaacatattcactttattatatgctagttatacatcaataaagctgttaagaatgatcaggtatgcaaagaagcaaggaaatatgatccacaacaaaaagaagaaatgacaggtacaatttaattagcagacaaacatgttaaaacatgttatacatatgctcaagaatgtaaaggaaaatgtgaaaatggggagaaaaaatatattaaaaaaaacaaaatggaacttctacagattaaaaatacaatatcagaaataaaataactatatgggagtaacagctgattatacattaccaaataaaagatcagtgaagttaaagacataggaatagaaactaccgaaaatgaattacacagagaaaacaaagtctggtaaaaatttatcagcatgtcagtgtcctgtggttcaatatcagatagttagacatgtgtaattaaagttccctagaaacagcaggggaggaaatcacaacaattatttgcagaaactgaaattattaatccatcaatataggaaattcaacaaacccaaggcagaatgaaaaaaaaagatcataccaaagcacatcataatcatattgccagaaatcaatggtaaagagaaaatcttaaaagtagccatagaaaaagtcattatgtacagtggaataaagataagaattacaacagactcctcatcagaaataatacaaactataagatagtggagtggtattttaagagtaccaatactaaaagaaaaactgtcaacctagatttctatacgtagtgaaaatatcttttaaattgaaggcaaaacagccagtataaaaatgggcaagagacttcaatagacatttctgcaaagatatacaaatggccaataagcatatgaaaagatgataaacatcactagtcattagggaaatgcaaatcaaaattacaaggagatatcacttcacacctattaggaaagctattacttaaaaaaaaaaaacaactgactaacacaggttggacattggtatataagtatctgtttgagtctctgctttcggttctttggggtatatatccagaagtggaattgttcgatcacaaggtaattctaaatttaactttttgatatatatctatatagattttgatacatatcttctaatctaggaagatatttgttataaagaattggctgacacaattatggaaactggcgagtccagatttgcggcatgggctgacaaactggaggcacaggagagccagtacagttccagtccaaagaccagcagcctggagacccaggaaagctgatggtgcagatgaagtctgaaggctggcaggcggagacccaggaaagctggcagtgcagatgaagtccaaaggcagtctgttgaattcctactaggttagagaggtcagtttttttattctgatcagggcttcaactgattggatgaggtatattcacattatggagggcaatctgtatactcagagttcaccagtttaaaaattaatcttatccaaaaatatcctccaaattgacacataaaattaactattacatacctacaacctatgtgtccatcacaggtaaatgtcaacaaaatatggcatatacatataatgcaatattattaagctttaaaacataatgaaattctggtacatactacaacatggatgaaccttgaaaacattatgttaagtgaaataagccagacacaaaagaacaaatatgattcatcttatgtaaggtacctagaataagcaatttcatagacacagaaaatagaacagtggttaccaggggctgaggaagaagagaaaggagttactgtttaatagggacagagtttcagtttagaacaatgaaaaatttcaggaaatgaccagtgataatggttgcacttaataccacatgattgtatacttaaatggtaagtcttaacatttatattttaccacaaaaataaagaataaaataatttttcagacaaacaagagaactgagtgcctgcagagctgtaacatattagatgttaaaggtaatgtcttcaagcagagggaaaatgataccacctggaaatttggatctaaataaaataatgaaaaatgttagagatgatacatattcaaatacaagactttttaaataatttgaagtctctttaaataaaaatgcctatttaaacaaagataataaaataggttgtgaggtttataaaatatttaaaagcaaaatataagacatcacagaatgggggagaacggaaggatgctgtcataaggcactttgactattcataaagtagtgacttttattggaagtagactgcacattttatacattagagcaaactttttctataaagatccaaatagtaaatattttagatgttgcaggtatagtaagcagaattctaaaatattttccaatcctccaaggttttcccctcccccacctttcctagtatgcatgcctttcataatttccaggctgaatatgattcattatttaatatggcagagttaactttaagatagagaaattattctgggtggtagagaaattatcctggggaactggaggtaacacacaagccctttaaagacagaatttctctggctggttgtaggggaggacattagatgtcaaagcataagagggtttaaatgtaccattgctggattacagagggagaggccaacatgggaagaaactgagagcaaccttgactgatagccagcaaggaatacaagtctcagtcctagagccacaaggaactgaatgctgccaaaagtgagaatgaagtttggagtggatttttctgcaaagccccagatgacaactcagcctggctaacaccctgatttcagctttgtgataatttgaccagagagcccagagaacctagtgagctattaaataattgtaattaattttaagctgctaagtctgtggtaatttgtcctgcagcatcagaaaactcatatagcaggccatgtgcagtctctggtgcagatttttgctctttttttctacttttcttggataatagttaaacatttacaaacctttattaacttgtgggccataaaacaaaaacaaaaatcaggccacaagatgagctgtcatttgctgattcctgccctagagtatccactttaaaaaaaaaaaaaaaaatggccgggcgcggtggctcacgcctgtaattccagcactttgggaggtcaaggtgggcagatcacaaggtcaggagattgagaccatcctggctaacacagtgaaacgccatctctactaaaaatacaaaaaagtagccgggcgtggtggcgggcgcctgtagtcccagctactcgggaggctgagccaggagaatggcgtgaacccgggaggcggagcttgcagtgagccaacatcgtgccactgcaccccagcctgggcgacagagcgagactccgtctcaaaaagaaaaaaaaaaaaaaggtaacacttttaagccaataaaggagataaaatggaaccattagaaaaaatttagttaacccaaaagaaggcaagaatagaggaagaaaatatgacaataagaaagctaatatactaaatgtattaataaatggcctaaatgctccaattaaaaggcaaagattatcagaatggttaaaacaagacccaatttcatgatagctgcaacagacctactttaaatataaaggcctagataggttaattaaaatattcaagaagatatatcatgaaaatacaaatccgaagaatgttgcagttgtcatattaatatcagacaaactaaacttcagaacaaggactattactagagattttataatcataaatagatcagttcatcaaaggacataagaatcttaaagatgtatgcacatgctaacagagcttcaaatacctggaataaagaccaatacaactgcaaggtgaaggacaaatctctaattatagttggacatgatagaatgtgtagtcagataatcagcaatgctgtcgaagatgtaaacaataacagaccaacttgatccaattaacatttataaaatagaacacaccatttaaaaacagcagaagtgcacacggaacatcacaaaagtaatccttactctagaatatgaaaagaagtctcagtacatttaaggggactcaaatgcatagagtataactacagtggaattaaattagacatcataaacagaaatatatctggaaaaattgtcaaatacttggaaattattagcatacttctcaataattcattggccaaagaagagagctcatgaggaacatttaaaaatattttgaactaaataaaagggaaaatacactgtataaacatttattgggtatagctacagcagtgcttaatgggaagccattagcaaatggaagtctcatacattgctatgggaatgcaaaatggtacaacccttttggaaagcgggttagcgatttcttacaaagttaaacatatttaacatactatctagcaatcacacttacaggtatttacccaatataaatgaaagcatatacccatacaacgaattcagtgtaaatatttatgagagctttatgcttattagcctaaactgggaaccagcctaaatgtctatcaatagataaatggataaacaaattgtgatatatccataaaatgtaatttaaaaggaacaggttactgatacaacatggatgaatttcaaaaacagtgaaagtttagtggttgctaggggccaggtagagatagactataaagaggcgtgaggaaatattttgttgtcgtcctggtggtacatgattatatatacttgtctaaactcatcatattgtacatttaaaatttgtgccatttattataaataaatatggttaaaataccattttctatgtgggaggaaaagattcagatgaataattattagaactaataaatagaatctatatgtattttatatatatgtaaaatcttttaacatatctatgatagccattcataatatataaaattaaaaaatcatattcacaatagcaaacccaaatcataaaatatctagaattaacttttatcaagaaatatagtggtcctatctagagaaaattataaaacatttttgaaggatataaacaaattttaataaatgaaagatattttaaaaaatagaaacaatataaggatgcaatatcaaaatcctaatttggggatgtaggagggggaacaagagagaaattttcagaatatcatctggacatgttactagaacaaatttaccttacatataaaaatatgtggccaggcgtggtggctcactcctagcactttgggaggctgaggcgggcagatcacttgaggccaggggtttgagaccagactggccaacgtggtgaaaacccatctctactgttaataaaaatacaaaaattagtcgcatgtggtggtgcacatacctgtagtcccagctactcaggaagctgaggcacgagaatcacttgaacctgggaggcagaggttgcaatgagctgagattgtgccactgtactccagcctgggagacagagtgagatgctgtctcaaaaaataaaataataaaaatatagttacgtgccaaataaatgacactgcagtcaatgacaaaccacatatatatgatggtagtcccatgagattatgatgccatgtttttgctataccctttctatcttttgatatgtttagatacacaaatgcttacaattatgttacagttgcctacagttttcagtacagtaacatgctgtacaggtttgtagcctaagacaataggctatgccaagtggcctaggtgtgtagcaggctatgctatctggttctgtgtaagtgtactctgtgatattcacgtgatagcagaattgcccaacatcgtatttctaagagtgtaatctgatgaagtgacacatgactaaactttattatgggaaatactaaacaatatacatgagtagagagaatagtataattttctcccatatttccgtcacatctcatccattttatcttttactttcagcctaccctctgaattattttcatgacaacttgaaatagtgtatcattcacctgtaaacatttcagcatgtatttttaaagctaagaagaaagtaactacaatgccattattattttggaaaagttaactagaattctttattgctgtccaaatgccttatcaatatttatgtttctcatttgtttttctattggcttttttgaatcagggtgtaaatatggtctatatattgcaattggtaaatatatttctgaagtctaattttattttattttttatttattgtctttttttgagacggagtctcaccttgtcttacccagaagtcttacccaggctgaagggcagtgcggcaatctcggctcactgcaacgtctgcctcctgggttcaagtgattctcctgcctcagcctcctgagtagctgggactataggcacctgccaccatgcccagctaatttttgtgtttttagtagagacaggatttagccatgttggccaggctggtctcgaactcctgacctcaggctatcccccccacctcggcctcccaaagtgctgggattacaggtgtgtgccaccgcacccagctgaagtctaattttaatcgccctcttttctttgtaacttaaaacaaaacaaaacaaaactaggtcatttgtagaattcctcgctgtctgatttttgtatcttacatccccatggtgtacttaaattcctttgttcctataattcctgtaaattattaattagatgtagaggattatgagatctagtttttttggggcggggacattcaccatgggttgtgctgtatatatccatcatgaagtgcatgtctcttttttattgtagtagtaatttatcgtctagatttgttatttcgttagggattgcaaaaatattacagtctaagtataccattccttatttatttatttatttgttggaatacctctataaagagaaactttccccctgcatcaccacttctgtttgttatttactgatcctcagctcatattggaaagatagatgaaattataaactgtgccatatctctgtctagcacctgccagagataaccaacagagttgaggtttttgtttagttttgtttttgttttttgtttattttttgagacggagtctcgctctgtcacccaggatggagtgcactggcgccatctcagctcactgcaacccctacctcctgggctcaagtgattcttgtgccttagcctcccgagtagctgagattacagacatgtgccaccacgcctagctaatttttgtatgtttagtagagatgaggtttcaccatgttggtcaggctggtctcaaactcctgacctcaagtgatctgcctgcctcagcctctcaaagttctgggattacaggtgtgagccactgcacctggcctatttgtttaggttttaaagtatcaatttgtgctcacagatttaaacataactgacatgttttaggtcattgtaattattatgcttattgatccacaacttttcctatcttgtgataatggaacctctttatgttgactcctcatacctttgatcctagtattctgaaagttttcttttactctggcctgaaaagatgtttttgactttttttttgcactagacctggaatcagacatttattcaagaaactctttttgtaaaatgttgtatttacagaccatgctctatatgcatgagtgtttattgcaactgaattggcaataaaattgaacttgtgtgtaagttcttatcttactgtatttaaaatacatacattaccagtaattacaacagtgtgatagtgacacaaaaataggaagatcaatggaactgaacatccacaaataggcagaaacatcttgttgaatttaaaatataatgaaagtagcactttttatgattagaataaaactggattattcagtgaatgtgtaaggatatctctttgcccatgttaaaagaaattaaataaaggtgaaaagaaaataaaggtgagtccctaccttactttttgtatcaaagtaattccagatggaccagtaatttaaacatgaaaagtccaatcatgagctcatttaaattagtcacaaaacatttaaagaaaagatcgagaaaacaatgggggagtagcagacaaagccaacctgctggtaagacattttaaaaatcaaatgcaataactaacaggatgagaagcctttagtcgttcattcattaagcagttatttatttagtgcttcatgtatgccagacactgttttacacaagtgatgtagcagagaacagatacatttcagacactattctaggcagtgagatgtagcataaacaaaacaaacaaaagtaactgctctcatggagcttatgctgtattggggtggggagatttgaacaactaagttaataagcttggtctaatggttgtatgtggagcccaccaaatattgaatgcagatttctttccattactcataaaaattaaccacatgctagtcataaagctgcccttaaaaaattaatacaatggattatgagcatactgtccagcctggatgccagctaagttagaagtcaataacaaaaagccgaaaaatgcagaactcgtctgtgaaacttttcttttcttttcttttctttttttttttttttttttgatacagggtctcggctctgtcattcaggctgagtgcagtggtggaatcacggctcgctgcagcctcagcctcccagactcagatgatcctcctgcctcagcctcccaagtaactgagaccacaggtggtatactaccatgcctggctaatttttgtattttatgtagagacaggattttgccatgttgtccaggctggtcacaaactccagggctcaagcaatccacctgccttggtctacaggaaacttacacatactttcagtataatgcatgggttaacaaaattaaatagaaatatagaaatagaattaagtggtcataaaaatacatataaattttgtaggctgcaactaaagcagtttttagtagggaatttatataggcttaaagaagaatactaataataactaagctttgcattaaaaatcttaaggaacagactaaactgaaagaagacagggagaaatagagataaagacaataattaatgaaaattttaaaatggttacaatagaatagctctgcaatatttaaaagctagaaaacaaacaaacaaaaaacaccaaatcaggctttgtcaggatttcacaagaagagaagagagaaagcaccaaaaagccaacattaggggactttttttatccaaccattcagtggacaatatgtccacactgtatgtctccttctagtgataactaaaaattgtgaatgtaatataaatgaagataaatgcaagtctggataaggtagaaagaaagatttcatagagactgtacaccgggttcagaactcagaatagtaagcagaacactaaagctggctttgccctgaggaaatttgataagctaggtgcatattcccttctattgtgtccctttcttggtctcatggtgacagaccccagctgcatcaagtggggactcagacagtcactaaaccttcagtgtaagaatactagaattaaattcagccagcccaaccaccctagcatacctcccaccaccaccaccactacttgttgaagacagcaagaaaggttgcctatctagagcaacaatgctaggtagataaaggaggaaaaaaaacattgggaccgttggatttatcaccatcagatacccctgaattcacatttacctggatggtctgaaaaagcccaagctaaacacttagctgtgacagttgaagcagtgacagatggttgtgcctccagtcacttgcagatgcacgtcttctccagagtaatacaccttcaactagtgctttcagtaggaaagtatgaacgcatagcccaaatcacagatgtacagagaacaaagaactggcaggataaaaagaacagacaatagaatttgatcttcagatgcttgagatttttgagaaattagagaaaatacaaaatatccatgtttaacatgtttttaagaaataaaaaaagagattggaaatataagtaaggaagataccatgaaaattatcaagaaaatacggaaacaaactaagtagaagttctacaaattaatcacgtaatgaattaaaaatcaaagctggtggggaattatttgcaaaggtccaaaattagcaagtaatagcttattttttcataccaatcgtgttttcttataccttcagtgttctatgagaaaataaccattaaccagaatgttatacacagcaaaacatcttccatacatataggtgaaataaagacattttcagacaaaatttgagagtaatgtatggcatcagttgttcactatattactacagaaagcaggagaggagagaaaagaataaaaaatacagggcaaatgagtctaatataagatgataaacgtaaatctcagtgtatcaataattagaattaagtgtaattggattaaatgctctagttaaaaatacaatggttaaaagactggatttggaaagaaaatctacctatatgatacttaaagagacacctaacaacaaagatacagaaaagttaaaaggacgggaagaaaaagatataccaatcaaatcctaacagaaaaacgctggtatacacaaataaataagtaaataaagctttgttaatgtcagaagtgatagattttatggcaaaatgctttaccgaagaaaaaggaccatgagtctgtaatgtgtccgttaaaatgtgggccccaaaatatataaagcaaaaattggcagaaaatccacaatcatagtgagagattccaatataacgtttggtatttgatagatcaagcagatttaaaaattagtatagaataggtaaatacacgtggttgacaagctttatttaattaatgtatacaacatggagcctatgctatattggggtggggaaaaatgggaagcaaaaatatttttcaagcacatttagcacattcaggaaaactgaccatatttgggccattagacttgtttcaatatatttcaaagtattggttagaccacattctctgtagtgaatttgttagaaattcatttaaaaaataacaacaaagctgtttcccacctttcagaaaagctaaaatccaaaagacgaacaatatgaagcgtcgttaaggatgtggggcagctggaactctttactgctggtgggaaactggcctttcctaataaagctgaacgtgtgcatgcacacctgctaccatgcagctccaccctagagtagagtgtttgtagtgtgtagcctgtgtctggaagtatgtgtctgtagcctaatggatgaatgcattgtgtatggtcatgcagtagaagctcatctagcaatgcaaatcaacgtacacaactgcatgcagcagcacagtgttgagtgggtgaagctagacacagaagagtacacactgtatgagtccacttatattaagttcagaaaagacaaaactatttacaggcctaaacgttgagataatggttacttttagggaaaagggaaggtttagtaatttggagggcacaagagtggcttctaggattctgataatgtgttgtttcttcagctgttggccattacctggctgttgctacttcgaggacactcgctgagttgctacgcttaaagtttttttactttcagtgtgtatgttgtacttctaagaaacctggaagctacataatttggaactctagagtaatacacttctaaataatgggtcaaacatatatgaatgttctttgctaaaattagtgagtaaaactttgaaaaagaggatatttgcattgcttcaaagcatctcccctcaactttgtagtacttaaccctggtggtttgaacatgtctgctaattttggtacctctttcttcttgaatttgggctggatccagtgagtatctcctgacaaatagagtatggaaaggaaaaacaggtgatttatactatagaaacctggcagatcccactggaaccaattgatgaatgtttccatcaccagggatgagtcatgtggagagcatatactcatacatcattagatgagaagggcatgtcacctctgtggtattcttttccagcatccatcatctcaatctaattatgagagagtatcaggcaaacccaaataggagtacactttataaaacatctgactagtgctcttcataaatgaataggtcattaaagacaagaaagtgaggaactgtcacagactgggggcaactaaggagacttaactgctgaataaagtggtttcctggtgggtttttgttgttattgttttgagacagagtctcgctctttcgccaaggctggagtgcagcggctcaatccggctcactttaacctccacctcctgggctcaagcaatcctcccacctcagcttcctgagaagctgagactacaggtgcactccatcacaacctggtaaattttgtattttttgtagagctggggttttgccgcattgcctaagctaatctcaaacccctgggctcaggcaatcttccttcctcggcctctcaaattaaattgggattagaagcgtgagccaccacacccagcctcctattgtttttttaagagtggcagggtctcgctacggtacctaggctggacctgaataaaaaaggacgttagtgaaaaatctggggaaattcaaaaaagtctgtagtttagttaatagtatagaatgaatgttggagaaaaacttaaagctttaaatgcttgtactagaaaagaagaaagtcttaatgagcaatgtagtcaacctaagaacagaataagccaaagccagtagaagaagataaataaaattaaaagcaaaaattatcagctgagcacagtggctcacacctgtaatcccagcactttgggaggccaaagtagatggatcacttgaggtcaggagttcgagaccggcctgaccaatatggtgaaaccccatctctactaaaaatacaaaagtcagtcaggcgcagtggcgcacgcctgtaatcccagctattcgggaggctgaggcaggagaatcgcttgaacctgggaggcagaggttgcagtgagccgagattgtgtcattgcacccagcctgggcaactgccaagagcaaaactctgtctaaaaaaaaaaaagtaatagaaaacatggctataatagaaaggatcaacaaaagcaaattttggttttttaaaagagtaataaaattgacatatctctcagcattgactcaaaagtaagaagagaaaatgagcaaataaaaaagtacaggaaatgaacacatgcttaagaaataaagagacatgagaaaatttatactattacatttgaattttgaagtgaaatgactaaattcgtattgaaatattattaaccaaaactgattcgagatgatagaaaaaatctgaatggctctattaccatgagtgaaattccagagaaaccctcaagattagcctagcacaactttgacatcaaattgtgacaagattgtatgaacaaaatataagccaaccatattcataagcaaagaagcaaaattccaaaacaaaacattgtaaactaaatacagcaacattttaaaattatatataatagctaaggtgggcttatcctaggaatatacaatttaggatttgaaaattattcactgtactaacagagtgaagggaaattattattccaacagatacagtgaaagctttttttttttttttttttttttttttttgagacagagcctcactctgtcacccaggctggaatgcagtggcgcgatctcagctcatcacaacctccgcctcctgtgttcaggcgattcttgtgcctcagcctcctgagtagctgggattacaggcgggtaccaccacactcagctaatttttgtatttttagtagagacagtgtttcaccatgttggccaggctgatcttgaactcccgacctcaagtgatccacctgccttggcctcctaaagtgctgggattacaggcgtgagtcaccatgcccgtcccagagaaagcattttgataaattcagcttttattcatgtttttaaaaattgattcaacgaggaatgagtgctacagaataggacatagggaatgaaggagagcaggttgcaggatttttgttactgttttggttttttgtttaagagacagcattgttgtccagcttggactcaaacttctgggctcaagtgatcatcctgcctcagcctcccgagtagctgggactacaggtacacaccaccacacccagtttggttgcagttctgaataggtgttcagaagaagtctcattgagaaggcaaaatttgagcaaagactggacagcagtgatgaagaaatcagtcaggtgggggagaatcagcgtacatacaggttttgacacaggagaaggtgtgggatcttccagaaacaatttgaagtcaaatgtggcctcaatagagaaaggaagagagttaatccaggtgatggaatgaagacaaaagagcgtgtcggcctgacacaccactggaaaggttgtggatgcgcatctgaaatgggaagccatttgaccatatgtttattatttgtgtttaatgtttgctaatttaattggtatgtaatgacataatgcttttgtctttattagtagatgatttttaaatgatgttttaccatgtgtatttccatttgctagtttatttttttaatttaacagctttattaagaaaccatacaattcacccatttaaaatgtacattttaatggattttaatacattcatagttacatgcccattattgcaatctaactgtaggacatttttgccctgcccccagagggaaccttgtgcccattagcagttctccccattccccacacctccctcctccatcctctgagccctgaacaaccactgtttcctgtctttcccgatgtgcctgttacagacatttcatataaatggcatcgtatactgtgtgatcatttgtgactggcttctttcacttggcatgtgttttcaaggttcgttcatgttgtggcatgtattagaacttcatcccctgtactgccaaataatattccattatatgaataaagttttattttatttttttgagacagagtttctctcagtcgcccaggctggagtgcaatggtgcgatcttggctcactgcaacctctgcctcccgggttcaagtgattctcctgtctcagcctcccgagtagctgggattacaggcgcatgccaccacacccagctaatttttgtatttttagtaaagacagggttttgctatgttggtcaggctggtctcgaactcctgacctcaagcaatccatccaccttggcctctcaaagtgctgggattgtaggcgtgatccattgcgtccagccgtattttatttatccagtcatcagttggcagataattgtttttttgccactttttggctattatggataatgctgctgtgaacttacatgtacaagtgtttgtgtggacataggtttctatttctcttgggtatatgccttgaagtagaattgttggctcatgtggtaatttactgtgtattttttttttctttttaaaccttttttttttttttttttttttttttgagagaagtcttgctcttgtcccctaggtttgagtgcaatggcttgatctcggctcactgcaaactctgcctcctgggttcaaacgattgtcctgcctctgcctcccaaatagctgggattaaggcacctgccaccacacccggctaatttttgtattttttagtagagacagggtttcaccatgttggccaggctggtctcgaactcctgaactcaggtgatccacccacctccgcctcccaaagtgctgggattataggtgtgagccactcgcccagccttactggtttaattatttgtggagatctagcattgaccttccatatattaatatttatctgttatttgtatcttgagatagtattttcataaatgttttatgtaatttttctcattggcttttgttttatttcctttttattattgttaaacaaaagatttaaaaaaaataattgtgtttagccatctcgtttctgatggccaattccatttattagccatcatacacggttctagcagcatctgggattctgctttcctctgtgctttatgaaagttaaacaatgttttattctgaattctttgactatctatctggagttgacttcttgttttctttaaaggtggcttcagagatgaagtaggtgttgaggattttcagtaaggtggaagtggtagtcaggagagggatttccagaaggagcaagttgacagttgccctttattggcttgcttaaggagctccctgcaagacagtggagaaaatggtgaaaagggaaggcagtcattagtaaaataccattttgctcgttagaactttaatgttgcaagattcacttttagggcaaacttttgaaacctgtctgtcttgtgatctttctaaggtctacaggtttccagagtttacttttccttcattgtcatcttctttccccttcttttaaaataaaacctatgacactaggattataagaagtggtaagaagctctggattttcagtcctacttaccacgtttaatcacagtatcttcctggttttctgaaataactgaaatcaatgtaaaatatcagttgctttagcgtagttagtgtagacagtgggaaatgtgcagaaattgtgggctcttgcttccaatttagcactctgggttgtgagatttggctccacagaaataaaattaggtggttagctacagctgtagttaagttcagtgatgtgagagaaaacacacacactggggattgtgggcctttcatgtcttcatttccagtgggatacaggaataatgaagtttctaaggcagaataagggtcacagattttatttaggtcattttgctacaattctaatttgtctttctttttacatgtattatcatgccattaataacaaaactttttaaattgtatttttagaagttctcctgggttctagatagactgtgatagcagggtaacctttagcaggttacttacctttcctctttaggtcccgggttctttaccaataaaatgagaatgaaaactgtatctagtagtgtagtttgaggattgaaaatgggtatttgtatttagcacagtgcctggaatacgttaaaagcacttatgaacttagctctcattattgcttcctagtagagtctacattgtgctaagcttctaggtcagcattagcttaatcttctagttgggatctaaggacattagtttttacattctgtgtcctacatttgaggctgggttagagaacagaagagtgaaaacagtgatcctccagtagctagaatgatgccaagtggttccaaagaagaaaggttgttgaactactaattaacaccataccgataaaaccaaaacaactagaaataatgtctgcttggaaatattcatttcacttatgggagcaaactttttgatagttcataaaatgccatcttggtatttgggagctaagaatcattcaggttgtccattaagaagactccccagtataaaaccagtagcgtatagccaactttaggtaaactaaataatgtgggggacaaagaaagcacaggttagcttcctatgtgattgtcacccaacatagaataaaatttcactcatatcacctaaacagaggagagtccaactttgtcaagtcaattttagattttttttgaatttccatttcttttgtaataacacttaacatgagatctgccctcttaacagaatttttaagtgtataatatattcaactataaaaacaatgttgcacagcagagttctagactaattttcatgttgcataactgaaactttatttcctgtagcaactctccttctgtacacctcagcacctggcaaccaccattttgcttctatgagcctattttagatactttatataagtggaatcatacagtatttgtccctctgtgaccatcttgtttcacttggcacaatgtcctcaaggttcattcatattgtcacatattgcagcctttccttcttttaaaggctgcataatattccattgtatatacacactatgttgttttaatccatgcatctgtcaatggacatttagagtatttctatatcttggctattgtgaatcatgctacagtgaacatgggagcactaatatctcttcaagataaagaatgtcttaaacaatttttaaaaaaatttaaattgacctatcatcataatccaaatgattttttgtgtaatatttatctcatgtaatccaagtgattttaagacttctattttatgtcagtaagatatagtattgttttaattcattatttctaaatgggttcaatatcatccttgttttaatcaactgttttcacttgatttttgtatatgagagagataggggtctagattcattcttctgcatatggatatttagttttcccagcaccatttattgaagggactgtcctttccccagtatatgttcttggcaccattgtcaaaaatgagttcactgtatatttatggatttgtttgctggttttctatgtcaatgtgtctgtctttatgccagttgtgtgctgttttggttactatacctctgttgtataattttgaaaaaggaaaaacttcagacgaattaaatttaaaggagtttaattgagcaatgaaagattcgtgaatcgggcggcccccagaatcacggcagactcacagagactccaggggtgccttgtggtcagaacaaatttatagacagaaaacgtacagtgatatacaggaattggaagtgaggtacagaaacagcgagattggttacagcttggtgtttgccttatttgaacacagttggaacattcagcggtctatgagtggttgaagtatggccactgggattggccaacactcagttattgttacaggtgtatactattaagttaggttttcagttttgtctgactattaagctaggttacagttcatccacaaggtctcaattatagaagtatgaagtccttcttaggccatatttagtttgctttaacaatttgaagtcaggtaatgtgattcagttttgctatttttgctcaggatattctgggtcttttttggttctgtataaatcttaggattgttttttctgtatctgtgaaaggattttgatagggattgcattgaatctgtagattacttggggtagtatggacattttaataatattgattcttccaatccatgaacatggtctatcttacctttttttgtgtgtcctcttcaacttctttaatcaatgttttatagcagggttgttcaatcttttggcttccctgggccacatttaaagaagaattgtcttggaccacacataaaatacactagtactaacaacagctggtaagctaaaaaaaagaaaaaaagcaaaaatcctcataatgttttaagaaagtttacgaatttgtgttgggctgcattcaaagccatcgtgagttgggcaagcttgttttatagttttcattgtagaaatctttcacttctttagttaagttaattcctaggtattttattttatttgtagctgttgtaacaaactattttcaatggtaaagacaggtttcagctcagatatttgagtgctatcaattttaggactgattttttttttttttcaaaagataaaagtgttgctgtctttttggcaaaaagcacttgaaaatgctgttctaaatagaaatacatgtagaatgagctactgattgctgtggctcttttgatatgataatagtttaatattaaaactgaaatgtttttgtgatatactgcgaatgagctcattgctcttaattcatattacaccacctttaaaatcctgttcaggtagccttctccaggagttccaccctcatccccaagccataagtaatcctttcctcctttgagttccagtagcactctttatacctctctttgtatttataaactgggccttgaaacataattatttgtatttcttttccctaataaaatacgagtacctaagcacaaactgataaacattcaggttaaactcaacggatatgttattgaatatctgctttgtccaaagcactgtgcctaaagctatgcaaacatgagtattacaccgctcttgtctttgtcacgttgttcctcatagtgcctggtctccctcttgacatttttctcttgtattcgaggatgccctttttttttcctcttacatctcttgccactacttcacagtgtattttgtctctgtctctagtagacatgtgaataatgaatatgcccaacgcttgctctcgaacactcttctcttttcaatacacacccactttaggtaatcttgtttattctcgtgcacctaaaataatatctttatgccagtgactctcaattatctatctctagtccagacacttctgaacatcaagtccacatattctagttgccattgaagtctcctgggcatcacggaaatgaatgtcttaaagaaaactcttcctcttttcttccacatttggtcctgttctccaggaaagcaccttcgtccaccctgctggcaagccaaaatcctgatgtgatcttggtcacatgctttcccacaccctccacgttgagtccatcaccaagtcctgttgattctgcctctgaagtatcttcctcctctggctcttgcccacatgccagcccacagtgctggcataatggaccctcgtggcacttctgctcagtccccacagcgttgtcacagtgactatttaaaatcataaagcaggtcttgctttaatctccttgattctcgttgttcttagagtaagatttagaaattctcaacgtggcatctgtgtatcagtccttttccagttccatcttttgacacccccaccctctgtaatccagccacagtggcattctttaaattccagaggtttgctgaataccccctcaccccgctgtccctttagggttttgcacaagctcttcctgttgaggaccccttctaccaagtgagccccactaaccctctcaattgaaacactgtttcctcagacaggctccacccaagccctcagactaaattaggatctgttctcttggcatatctaggtatcctgaacttagagcacctttggtaattactaagatttcttttgttggctgattatttgctcaatatctggctgctccatggtctgtaagatccctgagggcagggatcatgtctgttttgttcacactcaggcctagcaccagacacatagtagagagtcaatacctatttgtggaatgagtaaaataaatcaacataaaagttcaaaagcactctaaaatattgcgcaacagaatgtgtttaaaacttaaggctctggctgggcatggtggctcacgcctgtaatcccagcactttgggaggccgaagcgggtggatcgcttgagccctggagttcgagaccagcctgggcaacatggtcaaaccccatctctactaaaaacacaaaaactagccaggcgtggtggcgggcgcctgtaatcccagctactctggatgctgaggcatgagaatcgcttgaacccgggaggcggagttgcagtgagccgagattgcaccaccgcactccagcctggtcgacagagcaagactctgtctcaaaaaaaaaacaaacaaacaacagaaaaaaacttaaggctctaacttaatatatggaagtaagtttctaacccttgtgagaagacctttattagtttgtgactaaaccaggcgtgtgctgcttttctgatctgtccaattttagaattgttattaccaaagtatatatttgacaacaggaaaaatatattttatcagtttgacaacaaatatttattgatcatctgctgtttgcttggcatggttgtagatgcttgggatacagctggtgggttgcagcttactttcccacggaggacagacagtgtacacggagaatttcagctcctgaaaaatactctggtctaaataaaacagagccgtggcaggggcaggggggctagagaagtcctatttgaaaagataacatttcagctagcattggagggacagggagtcaactgcgggagatctggggagagctttccaggcagaaggaactgccaggacatctgaggaacggaggggtgggcagtggcccttggcacagtgaatgaaggaaaaacacacacttttatagagatgccatgacttggagttcttattctgcccattttggttggagacaatgatgatgtccagctcataagaatgttgctaagtaaggtaatgaaggtaaatagtagtaataatacacatcactgatagttttaaacatcattaatatgccttccacagaatttatgtgaaggagaaactgataaagtaaatgttactttaactcatggctttgtttatgtgtttgtttactaatttattatcttttaaaactgtagactgtgttgctaattatctgcaaacattaatgtttatgttgatttctctttaaaggttaaaaagctaaagagagagctctcacagatgaagcaggaactgctctataaagaacaaggctttgaaacattgcagcagtgagtatgaaaagactgaatcaactttagaataagctccctaactagtatgaatacaaagaaaatagaagtacagattacataagcgatttcttaaagaaacgtaaagtaaaaaagttcagagctctacaccaaaagaaaataaagcaatcaaccaacagataaaaaaacttgggaaagatctatgcacttgaaaagatccaaagtttttattaatcattggagatccaaagaaaccaaagtgaaaagcctttgtcttacctttatctcctggacccttgctggcctcctctgagattgtggtacagagctaagagactaggcacaagaaattcctctccacattcggctgggctggctgtacttgacccctgtgtgagcctgcagctgccctgggcccttgggtggaggcgtgtctgtctctctctctctctctgccagccccagggatgacctagagtctaaccctgacagatggcaggggagcaagagcaagttaggattattagcaaaggagcgggagtgcgctcctcacttcctggttcctctacctttcccgtttgctactgaagttggctgggccgttagcagagccctaagctgggccaggtaaagtggaaatggaggtgacagagggtcacaggatgaggatatcccttccgcattcccggcccctgaaagccactgttctccctgctgctgaggcccagcctatccaaaccgtgacaggcacacctgagactttctaatcctgcagtctccactccacagggcctctcatgggagagaagcagtccatggttttcacagccacatgaccacggagaggagttaaaacttccctcctgcttggtgcctccaagtgcggtgcagtatttttagggatgtccctggtcagttttgtgttcaggcaggtttcgtgttcttcccggcatctcccgtggtagcacctcaggaatgccaagctggtctcaggcgccacctctgtggaaagtacccagctgtgttccttttccctgtggaatcttactttaccttctgctcttatttgggatgctccaagcagcaagcccctttaaagatcctgtgtgtcactggccagataaacaaactggttgttcttgtttgggtgattagtcatatcttgggatacgcaggcactgctcttgaccaccagtcagacgcatgactttaatttcacacgtgctgttatcatccagactccttttttcctgcttaccgcatagaatcatgaccctgatactccttcagatgctcccatcctagtggttctcaaacctgactgcatattagaataatctggagagtgcttagaaaaataatgtttctagtctctatgccaggtatattttatgagatcccaagtgcttctcaagtccagccctgttgtaagaacctcagctggttgcagagctccccgataaaccaggcagaactagaatgacataaatgcattatttagtaattgtttatcagcataaagcagggcttcgtggtgggggtggggagagaaaacagagtttgaagagtgccgtaacgtgtttagccatatgttccacatttttaaggcacatgaaattataactcgcgtcaccatttgggattaaaggttagccaaacttgctgtctttgttatattgatgtaacaatgctgtattgtttcaaagcagtttgcttgcaagcaatttttataggaatctaaggcatgtttaagaatctgtcaataacattccacaagaaaacaatagacatttgttgtagaaattcaggcattctcttggaatgattctaatcccttgaaccgagagcagaaagatatgatatctaacatcagagacctctcctgtttatcttaactatagacaaaataaagctgttcttattcaaatgttaaccaccatactactaaaacactgaatgatcaacaatcaaacccagcagccagactttttaagaaaccacattcttgatactataaagggacttatatttgtggcatgacagaaaatatatttcaggaaaagatttaaatagaatctgattgtaggctttgtaacttttatttacaatagaatggaatatatttgttgaatctggaattataatgtaatttaaacttgagctttcattttacttggtacaatagttttatactgggtagacaaatgtggcattgttctctacgttattcatttcagtttgtggtcccaaatttgacttcggcctaagcagcagtgtagtatatgtgtaaatggataccaggaagatgcctgtttccatttgctgcctccagtgtgcattcagaattggaaaacaggctagtgatgaaacagcaagtcacaggcatatacagattctgtgaaaatttggttctcaaggtatacactttccagagaaggaatgcaagtgaacatattttatctttcaaaagagactaatatattgagtgaaaattagttatagggcacactcaagtcaagaacttccaaaagaaattttaagaaaaaaaacagcttttctcatattaagaacaaaaagcatgatactttaagtcagcaaatgatgctcatacttcggtttattttatgacaagttagggtcaaaagagaaaaggtgggaaatgaaaagtggaggagaaaaacaagaaacagtgaaataaaggaaaaaggcagcacttaaagtagagaagttcaaaggaggcaaaagaaaaagagcagaaacgttccatggtgaaagctgagctgtgttcttcacatttagcattctgttgagcagtggatagccaagaaattttcatgtattcaaagctctctgaaatttaaattagcagtcttgaaccagtcctgcttttattttttaaacgttaaggtttttttctgaaaacagcttacctgcttttattttcaaatgataaagtttatgttcatttctgaatcaaagatttgttttatcattaaattctgaagactttacacaaacaggaagaaattacttgagttttagaaattcactttgacacaatttcagatatccctattactacctattttatgaaaccccacattttagtttttatttttagttaaaaagtgctacatttgaaaatgccaaaatgctatatttggaaatatcatttgttttatttagtaagccatttcctcagccaagttggtggatataatacttcagggagtcagaaattccattgataaatctcttcccaaataagtagaattagctgatattcaaagtacttcactagtcccatcagatattctaaatgtggtagtcataagagccccagttctgaatctgtcattttaggatagttcccctactagctaagtgtctgtgcaatttggggtataaatttgcattaagtttctcccttgccttcttcatttggaagaaatgtgactaggggatctttaggggccctccccattctaaacactgtgtgtgtgtgtgtgtgtgtgtgtgtgtgtgtgtgtgtgtgtgtgtgtgtgtgcatgtgtttaatctgtgacttgattggttgtactttattatcagatgatcttatgatcaagtttattttattttcttaggttcttgaagtctttaattgcttgttcagcagcataagatagttactaaaacagtgcttggggaaatacattatctataaaccgctcttgtttgagtggactttgtttggaagagtgattaagatggcattgctttattttttttcagattatacctttcacattgaaaataagtattaattattaaatgttttaaaccaaacgagctcagagcctgttttccccgattcagtaggtactatttctctggagactctggataaaaccaaaaatatgtctaagaacgtgtatagagttgttgggtggggcagaggcatagccatatgtcccacaaggagaactcgtgcagtattcataatgaatcccagatagcacaggcagctggggaggaccaggagagtgatcatgaagagtacatgaaactatttttttaaaagaattaggtaattcgattaggcccttcgaacacaaagaattaggttacgtgaaatcctctagcctaaggtgacgatgtaaactgcaaggacacttggtaagcagctctgcagggataataaattagctcattgaagagctgtttattcaatatgagttgagaaatgactactgcccttctgccgttttcctaagtttgaactcatccagcaagtcaagcaattttatcttgactcataactttcataaaagcagaataaatattatatatatatatatagagagagagagagaaataaaaactaaccacacaatccaaacattgtaggatactcactagtataaataataatttacttattaaccatttattaaaggcctcccaagctgcaggccctgtgccaggttttgcacagacattacagcaaaacattatgtaaatcaggtggcagtttacttgcctctgtgttcttcagctaaagcatttgcccacgtcttttacctttcttgggtgaagatcaggatcagcacttgataaggtttgggttcagccagcagtgggatcattcaaacagattgaaggcaaaaagacatgcgtttgtttgagcccaaaagtgattagaaatggactgggtttgaagtgagggatgggagaaatcttagccgcctgtgattaaaagagaaaggaggggctgagacgtgcggatcacgaggtcaggagttcaagcctggccaacatggtgaaaccccgtctttaccaaaaatacaaaaattagccgggcatcgtggcgggtgcctgtaatcccagctacttgggaggctgaggcaggagaattacttgaacccaggaggcgtagtttgcagtgagctgagatcacgccactgcactccagcctgggcgacagaacaagactccatctaaaaaaaaaaaaaaaaaaaaaaaagagagagaaaggaggagaaactgcctgaaaagatgattgctggtatatgacagtcagcagtgaaataatcatccaactgagacaattccaaaccacttcctactctctgtttaacttatatgctatcattctttgatattttttctttctttttctcttttcacagaattgataaaaaaatgtctggaggccagagcgggtatgaactcagtgaagccaaagccattctaacagaactaaaatctatcagaaaggcaattagctcaggagaaaaagaaaaacaagatctgatgcaggtacattataaaacattttgttaagccaaacttctaccttctgaggcccccagaaactcttactggggcagaagtgctccctcagagtctggatgacccttctacctctgccacatttgtgcagaatgggccctgtggagattgttgcaggcacaaaggtagcctgctgccttggaggagagcagagtgattccaactgactggtatgcttcgttgtaagcagcctttggatggcctttgagatagtgggtggtggggcctggagctcatgtgaggagattaacatcttggtgcaccctgaaactcactgaaaacttcatatgagtccccagtaagcagaattctcagcccaggatacacaagggatatatcatttgccatcagtaagtagaaggcttgccttttggggatgaggctatgtgaggagcttagaaaagttttccgacccagttgattctggggtgccagctaagggtggggcggggagtgctgacccagctgggggatgcctatacagttaccctagcaaagctgccaatggccatagatccccttactaaacctgttcacttctcagcctgtgggtcttaactcccagtgatccagcatcatgtgtagaaaacacaaaatagccgttaagtgatcagtattctcagtatctatactatcaaatacagtcaagtttttttttaagggtgtctctcttcctctccttccctccatcccaaacactaagaattcttatttcgtatatttggagttcttacttagctgagggataatttagtccgcatctatgggaaaatgttagagtcactgatgatgtttacattctcaatagaacatctacatttaaataccatatttaactacttgatgttggttttcaaaatattagttgaatatagataaatattcttggatccatataattttgcattacttgcaagaagaatataaaataatatagaaaagacaaaataataatagcatgtaattgtaaatactgactttgtgccagacattcttctaactgccttgcatataaataattcccttgatcctcacaacagccactaaaggtaggcactgttattattctcagcttacagacgaggaaatttcagcacagaaaaattaaagtttcttaaagtcatacagctggtaagtagcaagactatggttcaaacccaggcagtctgggttaacgtggttttaacatacatataacacatgcaagactttacttgtgtgtattttggttttgttccacaattgtcttgctgattaagtcagtcattccagaaatgcatgtagtaggtcctttaaaaaaaaaagttaatagaactggagcaaatctacattggaaccttctaattcaacaattttaggtcatctttcattcttcctataaactttggattcatctgcaggcctgattaaattaaaagattagatcccttttcagttactaaattacattaattagtagatgcagagattgacaatagagttagaagaaactttagatatcttctgtgactttcaaacctctttgaccacagtaagaaatagattttacatcaaaacccagtaacacacaattgtgtgtacctatagatacacaggtgtgcatgcacgcgcacacacacacatacacactccaaatgaatttcacagaaatatgcctactcttaaactggtgatgtactctgattttattttctagtatcttctatttcatttaaaaaaatactagtaacaacctactaaattgatagaatgcattgccatcacagatgagtttgaagaacactgactttttttcactgtatagatggaaaaatagaaaagacttgcacaaggtcactaaaaggtttttttgttcttttctatattatttgatgtgaccatttaagttttatcctcatatatatatactatatatactatttatactatatatacactatactatatatatactatatatactatatatatactgtatatactatatatgctctatatactatatactatatatatgctatatatgctatatatactatatatactatatactatatatactatatatactatatactatatatactatatattatatgtactatattctatatactatatatactatatgtactatatatactatatactacatatatactatatatactacataatatatatataatatatatactatatatatattatatatatagtatatagtatatatatccctttgagagaaaatagagaaagttaggtaaaaaatttcagatctctgatatttctaattcctcctaatcatgaaaattttaaatatcaggattaaatacaggctcttttgttgataataatggtttcttatcattttattaggattaccctagggtttcctttttattgttttaagtaattcagattagtctttccttttcaatactttcacttgttcatatcctccctctaaagtaaacacagtttattaaacctgagtgcccacagcaggcacatttgcttttgattattctctttaccaagccaaacatgtcaccacaggcagtgccatgcagtagacacacagatgggcttgttccatgcctgtgccactcattagcaacttctgagcctcagtttcctaatccctaacattgatgtgagctaaataatctcttgggtcctgtccagatgtacaatggcttaattgaagaagtcttcaaagtaggaagttcttttactgtatctaaaatgagagattatgttatagatattctgtttccacaatttcagctgcatgaagtgagtgggttcctattgaaatagagataacttcttaatgaaatttttagaaataagacatgcatgtattttaaagataccgttcataggaaaatgctgttttgagatagataagacaactggtttaatatgatctcgcttccaaagtcacatgtatggaggtgcaaaattatatcctgctgttattttttcaattatataaaatggtaagtacctactaaaataaagttgtttttttccattgagattagctctttccttttaatttcacctggtagggaaggtttgctgtcttacttgttaagctttatgaaacactttgtgttttctgaacagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatgtaagttatctgtgctgaagagttggcccagtgttgtccttgatgggccttaattgcaatatggatggtgaactggaaccagaagtatatgtgacttggattctggctgtgtgcattcagtgttccattttcgtaagattagttttaaaaatcatagccttatcttttctatctaggtgccaagtatgtcaggatttgtccatatgagtagctttgttcaaactttctcatgctatattcctttagagacacgctgaaaggctagaggcatatgagaatttaactttttcctattacgtttagagtcttggaaatgtaggtcctttcaaataaacattaggccaatgagaaacagaaaaacatgccttttaagactaataagaaaacttgtttttgtaaatcttaattgattatattaaaatgtttaatttgtgatttatatctgccatttaaatatttaatgtggcttggctattgttaactattttaccttctccattttgggatgccattagcaggtatttacttctcaatacattcccatttcttttcatattcttttatgctgctttgaaatatgtgctgtgaaagtaaaacaggtagagatcaacagtagggcttacctgtttgaaaattaatttttgaacttatttagtttatattttgtacagttgaaagctaaatgctagaaattaggctcataaaggcaaaaaaattagttccagttcataaattttattgacctgtacacccttcataaactctgagataccagacacatttaccttggtatttacagtatcaggatattttttatcttgaatttaacgtgtagagaaaataatgttagagtctttgaaaaacagatgagcttgaattgaaagaaatgttttgcccctactgagacaataaaataagtgtcttttaaaattggtgtttcccgatttcagtaccatcttctttaacttttcaattacacatacttcccagaaacaaaagcaatttacttcattcattagcagagttaattgacttttttcctttttctttttccactagattggagtaagaagtagatcaaatttagctgaaaaggtcaggctaagcctacagtatgaagaagccaaaagaaggtaatgacagagaagctgttttgtgcatggctcaaacattttcttttccagaattaatctttactcctgtggtgacatctgctgggcactccccatacattcttaccaaggccacccttcggttttagcatgtcagggctgcttcctctctggtctaccttttcttccccccgccctccaccccccaaccaccaaaagctaaagaacagggagaattagtgagaagtatacaaatgaacttgcccccttctcctctgagaaaaaagaagctttgagttggtacaatacttaactctcaattaaaagtgagaagattggttgctttgatggaaatatgatacagtggttcaggtataggactaaatagctgttgaggagttctaaggcaaataagtattgatttatttgcctttgatttgaagggaagtcttactgctaatgtccttgaaggtgctgaggtggcagttccagtcgacttaggttagggaaaaggaagagagattctcatttctctcttttacctcataaactcttcttaatccctgtgctatcttttacttactttgtgattctgctggagtgagacataagaaacttccgtctcaacaacaacaacaaaaaagagatttcactatccgtatctagtagatagactcaaatacttttcataatatagaactccttattatgagggaaaggattatactgatacatttgatttcattattttcctcataagagctttaaaatgccattgggttattatttaggaggacattgggagaaactgcattatcgtcctgcaagaaacaggaatttatcatgtttctccccatgaccatgaaaagctcagctgagaaccagatattgaagtatattccttattattggtgatgatgataacttaaaagcaattggccgtagtccttagaggttatcaggctttaacaaagtaaaataaatacaatattcacctctatgtaacctgtattcttaatattacttggttcctcacttcctgaaagaaacctaagcttcattccacaaattattaaccatgtgagcttgaacaagtcacttaggcgatctgaacagcaatttactcagctaattttaatgcctttaaattttctctgggagattctaaatttcttcaggttagggaaaaatgtttaggctttattatctccttctcagtgcccagattagtgccttcccttcaataagtattgaggatcaacttctggttttgtggcccggcaatgtgccagctttcggtagatagtgcctgtggtccccttgttgtgtgtccacctgggcagggctgtggacaaagccatgaatttggtctgcttttctgaaagagaatggccattactcagaagcagtcttggagaactgggccttaagcccctgcattctttcgggcttgactcttgcttcccatggatcagcttcaactttcaccctcctttgacttctaagtgaattttatctggagctcacatcacatttctcttcctaggtgcttctaaaactcttcttcatattctgctccccaaatttggaacactccttctaaaataaaatttaagacctgcctaatgtctgatgacacaaataataaacgggcgcctctttttcctgtattatgttattgttcctggttcagttggttaattcagtcacatcaaaacttcagacattggttctttcccacttggttgcattggcgtgccatttggggttttgttttaaagttactagtgatgctgatgagaaagtaaatctcaagcgcttatgcatatgttgaaaatgctttttcctcctcaattctgattaagtaaagaggcaggttgtgtttctctgaaatctgttttctcctccagcccttattttatgtgcttaatgaagctaataatatcatgcttatttcgcattttgatgattaattttctagtatgttgagacagttgtttatgattttgtggttaaagctgaagaatagctgatgttacttaaatctatcataagtgcagatggggggagaaaatcagaagtacactgcatacaccgtgccactctaacatgcaattttatttttaattagaacaagaaacttatggcacaaaggtatagatctacttccatctttgctcttgattatgtttttcattcaccttttctcttcccttctacaagttctcccatgaaaatgggaaagtatttcttttctgtttttcgtattttggtgtgtactgttaacaatatccaaagtaatcatccaacgtttttctgtagaaacatagattccttgtgcagacatcagtggagttcatagttcactgagatcttgtcgttatggtcgaaagaaccatgtgccgcttaccttatgaacagtcctcattgtctttacagtgccacgtagcaagttatttgactcaggtggttaggacattcgtactgagtcgggggtaatgttaactctaccatgtgttacgaagctctagacataagagaaatctggggtcaggcaaaattatggaaacagtgaggtttgcctttggtgcattttcctcctccttctcctgtccctgtccacatcacttcagcacctgttgtcactccagtggtgtcatgccagctgcctgtactagtgaaggtccaccgtatgctgcctgcaaatagctgtgtacagagcaaccacagggctagcacaataatgtataaagtgtcagtgcaatgactgctcagtaaatggcttgtacaccagtcggggcactgatggggaggagactcacatgcagcttaaggagaatgtgaacgggagaaggccaagccctgccccttctctttggcaatgggggagccttgatggatcaacccctgactccctcccagggtcttgctctgtcacccaggcaggagtgcagtggcgcagttatggctcactgtggcctcaaactcctgggctcaagtgatctcaccttagcctcccaaggagcagggaccacaggcacacacatcaccacacctggctaatttttaaaatctttaaaatatttttggtagagacagggtctcgctatgttgcccaggctggtctcgaactcatggcctcacatgatcgtgctgcttgtcctcccaaagtgtcagattacaggcatgagccactgcacctggcccaactgctttcataccagttggccacaccactgctctctttgctgctctctccttccctgacttactaatgccctagtctctgtccagcctgccctggggttcccattttactagcggacagcatctaaaacacattggaataaaatgtatagtgatggcatctcagacatcattcacctcagtttttttaaagggaaccccccaggcatctttcctgtcacctacacaggcagtcacacgtcagagctggcctctcgtggcgcccagagcactcagcttttgaagcctctgtgtacttggccttcacccttttgtcaggtagctgggtatgctcactcacattttaaagatgggggaaagaagtgggtgacagctgagtgcagagacaggcccagagactggtgtgcaaggctgctgctcccactccggcctctcaccagtagaccacacctctttctggtaaggtcaagttaggaaaatctggacagcatgtcaacaccaaatttggcttaggctgtgtttacctttctcaggagttttaagtatgtgcatacctcttctatctttttttttttagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagaggtttgttttccttctggaaatagggcagcttaactcttgtgggggtgtcttaactggatactattttccctgggtttggaaatctcaattgcatctgttcttagtggactgagaaacagcacaaatggactttctgtagaacaataaagtgcaccatcctaatgcccgacaggataagttctgtgttttaggaacgtgcaaaacctgtgacagatgttgaataactaaggaatgctgacataaaaccaggaatgtacatcattgatgaagtctgataacaatagctataaactattgcactccgataagaaaaattatctagactgttagagcaactgaagcttcctattctgggttttattactcacaggaatgcaaaagtttattgctagtcatttcacgaggaaaagacagcttcctccctgtgataccctaacaggtcacaacgtactcacttgcattttgtttgtcagttgcatccctcccgtgaaacaggtgaaactgtaaaggaaaatactctaggcaattttcccatctttctctgggaaggtgtgagttgattattccatctaaaaaaatccagttctgcaaaacagatcagctggaatgttaagtgaagggacctctgtgtgtcagtttgacatgaacgcatctgcataagagcctgggtccaggccttgatggcagaatgggttggatacctgtttcaggacagaccagagagccgttgagaacgaccgcatgtacatcctttaggccagccagtaaacagcagtgcctgtttcagggtgatgggaaagaaattcacattgatataatttcaagtgacctggaagtaagtttaaaacacccagccataatccagttgcttcaaaaaaaaaaattgtggcgtcttgccttctaattccttgtcctcaataaatgttagggttgcatggctacataatatcaaaacatttgaaaagcagggggagggagagaggaagacgtctctgacattcccaggtaggtgttagcatggggactcacccaccccaacgttaaccgttttaggagagttgacttctgtgggttaaaatgttgatcaaggtaacacgcagcctcagtgtcatagctgtagggaacatgaaaacgtatcaaaaggaaaagcctctgaactataatcttctgccctcttaataattctcatctttgcctccatttccccttcttttcttcccttcttgttctggcttttctgtctaattttgctgaccaaacggtcagcctgagggaagtgtcagccaggctggcaaagcaaggccccatctgacaaagaccaaaaggaacaaaaagagtaagaaggcaagggagaattaatttgtttttgttgttgttgttgctgttgtttttctgaattaccctgatgtgtctaaatttgtatacctaaagtttctagctacggatagtcatcagtagctatgatgaaatgggtagcttttatgtggcccatgtataaaacagcaatgatgtttcatactactacatagcatttacatattataaaattttatataatcatacgtgtctaatgtgccacgtccatctcagctgttctactttgtagtaggtgaatctaggaaggacttacaaacagatttgttctggcagagaaagaagacatatttgtttgtcttagtttttattgaggtggcgtcttgcttgccttttttattaggagtagagcttccaaaaaatgactcatgatataacattaaagatagcaatttgttcctgagaacctaaactttgactttttcctaagtacctaaactttatacttttgtttgcacacacatagtaactcaaaattccagtgaaataggaggctttttttccttttttttttttttaacgaacagcccaaacctcaccagagacagtaggcttgaactcattaggaagaggagctataagatatttattttaaaaattatttatttagtgagatccagccactgggtttgtgtcatctggggagtaagtggtgtggatatgatacctccatggccctgtctcccatgattggatgttagcaggaagggaaacatgtattttatatatgtagtatgttgactttctgagttacctggaagagccaggtcatttagtattccaaataagtggatactagtttccttatcagtgtctatggccaaaggcaaatcctcatacttacattgccatcaaaggttgaaggactcagacattcttgcttgatcagcttaaagctttctaactcctatcctgggatgctcaaagtgactcagtagttcacatgtccagaagagcagaacctgctgccattgggaacactgaatcctttctttcccaagtagatacaacctcgtctggctttgggttttgctgttgctattatggttttgctttctattcccccatgctctggcattttttcttatggcttcaccctttcgtgtcttcctcctgtgtgtgtgggtttctgctctgctcattgctgctgttgcactgacgccgggagtttaagagggaagagaacgcccttgccagcagtgtctcctcagtgtcaaagcagggctggctggagcttcttttgggaagtaggatttgctgtgtgaaactcagtttcatcatagaacagattgtgtgccaccaaccccaaatccttccttttcttcttggtacctacatgactgtcaaagctacctgccgtattccccaacatattcctgttttccacttatatttggggttcccattatttcaggggtgacctctggcaagattccgagtcattgctgaacgttggtgtctgaaggagctagatgcacatgaattttcagtctctgagtgtgatcctacagcccccccccccccccccccggctctgttcctgcccccacagggctgcagtgtcgcccactgggcctgatggcagcgactgtgctcgccacctggtggtgggaaagaggtgctcatggtgaagcattgccaggcctaaagagaaattgctcgcaaatgaaaaaaaccatgcagggaaggtgtttctatgcatctttcgtattcttcccatgcagttattgaaattccttaaactctgtgctttcctatagctggtaagatcttaacattgctccttgttttatcacaagtgttgggggtttgccttgtaattgccaagacgtcttaattgtttcttaattatttgaatgtttttgccactgcttctgaaaaattttttaaagcaaataggtgggggcatgagtgtcacttagttttgagtggaaaagggacttcctgcttctatagatgacatgaaattttccctaggtgcagaattctgagttcaggagaaaccaggctgtgcttctctcctgcagggcactgagggcagagtcaggcaggtgtgaaggcccacacttcacaaagggcagcttgaaaggggatgtggagcagatgggccagggggaggaatcttttaagggccaagtagaggaaaccctttctcatccagcagaccaacaggcaggagttggagaagaacctagagagacaggtgtgcacccttttgagagggctgatgtctgcaatttcttctaacccctggttatggggaagttggggagagcatttcacatgaaatacacgtggattctgaggaagacttcaggctttcgctaggagaggctttggtgataacatcagagacaaactgcggcccactaggagggtttctgtgcctctccccagtgccttcctcatgcttctcccagggaaggtttcatctcaacaccagcaagaacggagggactggccagggcaccctgtgctgcagggagaaagggctgatgtctgcattctgggattgtaggagctaagtgggaaacgtgaacaagaacacaaagacaggcatctgtggttcaaagcagacattaaagggctggaagagcagctgccgagcatcacctggagaaggctgaggacgctccctagtgatggagaagggacagcactgaaagtgtggctcagggtcacattctgacgtcatcctggtgcctcctgaaagcattagaaaaaggcttcattttaataaaagcaatattgagttttaaaacttccttccgaagtgtttctcttgtttcagaagacatggattttagtagagtttggggctttcttcagacctttgtgcacttttaattcagttagtctacttcatattacttttttcctcgttgagtttttatttatatttgaaagatttttaaaatgaccgctgcttttaaaaatacacctttgaaagccatgaattaagaatttatcgcgcttttgaagtattaaagaaaatggcaagaattactttttttagtttaacatataatggaatagtgttgttgacacatcaaagggatagatacctataaataaaatatgggcatgtttccttactgccaaaaacatatataacatttcaaagagattagaaattaaggaaattttatttttctccaaagaaaagtggctagtttttatatcaccacttttcagggcatgctgaggctttgaacaagtcagatttgtttttcttctctgtcaagcactttctcatacattactccattgatccctttaacagccttaccagggagacacaggggaattatagtcaccattttacagatgagaaaagtaagacccttgattcagcgacttaccaaggatatgcagctagtaagctgcaaatcaagattagaaacccaggtgccctttttctgaattccattctgctgcttactgctctgaactactttatttcatgatgtctaaagaccttcacacgacatagactatacttgcacagactcttagttgcataaacccctgggtacttggtatattttaaaatgacttactattcaagtatacagttctataatgctgtactcttaaaaaaaagaaaaacttttgcagttgaatgtggatgaaattttatgatagtccgacgcggatgatgagatgtgctgtagctcggaaggggaatcacttttaggtcatcctcttccctaaacagttgagcccaaattagcccacaatggtattgtggactaaaattgtttcttaattgctaattcttatcaaatcagggttgggaatgttatcactaaatactatgttggaacaagcgttactaaattcggtatttagggtgacctttactgttgctgtgaaatgttttaggaaagggttcccaggtcacagatctgtgtcaggattctagtctttggttagttttttgtttccttggttattttcctcctcactcttcttccccaactcaaaggaccatattacttacccatttaaaaagattctaggctaccagcaattttaaattctcagtgacatggtgatggggcataacgctccctccccatccttcagcttggctcgtgcagctctgccccccacacttcttgccggtgtcctgttttctgtctgtggagcccattcacatttttcccttgtgatctgtaatgtttgtacaatgagaatctttctttccttttagttttcatattttgttataatcatttgaaaataattttttttcttcctagattgagattggaagagagaagaaaagagctgctacagaaacttgaagaaactactaaattaactacttatttgcattcacaacttaaaaggtgagcttatcagatttttgaggggaaagcttttctccgaatagcatgttcttgttcatctttgattacttttcactttatttccaactactttaaataaaatcattatagtagcacagttactgtttgagtgatcagatttaaagtcacattttcttttgcatgaacccagtgtcatatttggaatacatttgaaatatgttatagaaagaagatatgttttagctgtcagtacatttaggataataacgcatttttcccattgccccattttttaaaaagggaaagtggaggagctttgccttaaaatagccatagatttccttacattgatgagaaaaatactcactcctcacattcacacacaaagaggaaacgtgagcgaacccaagggtcttttgtgtgacttctttctttttataagcttgccttcttttctctaaaaataaaaagctttttttttaataaaaaactacattaacgcttttgccctgttttttcttgctttcaatattttttaatggcaaagtggcttctagatgtctatgcaaataaacttatcaacaggtatttgattccttttatttttgcaaaaggaggataatgtttaataagaatagatttgctacttaaagagtatttggagagcaaggctgaaaaggttaacgaagaagcatagacatggtatacagttaggtgccacatgatgactttttggtcaagggcagactgcatatatgatggtggtcccgtaagattgtaatactgtatttttactgtgctttttctagtttagctatgtttagatacacaaatactaccattgtgttataattgcctacagtattcagaacagcaactgctgtgcaggttcgtagcctgggagcaataggctataccacatagcttgggtgtgcagtaggctgtaccgtctaggtttgtgtaagtacactctgtgatgtttgcacagtgatgaaatcacctaaccatgcatttctcagaactagaccaggtcgttaactgacacacggccgtaatatagggagttcctctgtccctggccattgattccattctttagcaggtttcttccctctgcagatctgaaggagccagtagagattgtgattaggttttccattttgtaacagattttatggtgtgtgctttttgtctttcagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcaggtaaatgcagccctttgctttcatgtattccctgttagtgattttaaggagaatgattggagcattatttttccatataaacaaagggtatgattccccttctctttcttttgagtaatcgttttggcttcatttaagaaggagcttttatttatatacctagatatttttcattatcaaataaaaattaccttccctatttagtagacttaatcatttagtacctgctcagttgtccagagacactctgtgtgtggtagctgactgggaacatatgttgtgaacatatttccaagtagattccagttctgaaatagcaaggcaaagaagaggattttcttttaaaagttggcctaaaacagattaaaaccaaggcaattaacatagtagctaattagtaccaaggttcagtgtttagattgttcagggaattctatataaatacagtttttgtttcaagccagactccttttctggcgaaaagttaatttaaaacagcaggttgcagtgtatggtattaccctgccaccttctggccaggttaacagttgcagccccgggaagggattactagagattgtagttcttaggcctgcatttgtattcaaaaagacagaaacaggaaaaatatcatttttttgtttgtttgtttgttttcctttgcaaagcaggaactttgaatatgttagatatgattgtaaagagcacaagatgtttcccttgttggcagatgatcactgttggtctgaggaggatgatctgttccagagctagcttgagacaaaatgtgaaataaaagccccagtgctcatctacagctgtcctgttcacagctacatgttttactgaccacacaaaacagggcagggctctttagaagtgctctcttcctgttcccagaagcatttttatttgtatgtatggtcctaagaattctgagtaattgattggccaattcagatatgtaaagacattgacaaatccaccttgtttctacggtttcaaatactgaagagccaagtgctgtgccctgtcagtggcctgggcctgtgggagggcccatgagacatttgtgtggtttgtgcgccctctcctggggagatgtcaaagctacaagtagcaggttatggaaataaccacaaagaaaataaccaggggaatggtgtgtgtacataatggccccaacaaaacagaaagccgcgtggggccttcaccactgcttctgggaaggagtacggtgtgtgtgcgtgcgtgcgtgcgtgtgtgtgtgtgtgttagggggtgcataccactcctggaaccagccaagcctccactcacattttagtcaccaacgtgtttgggtaagcacactacccaatctctcaggattatgattccttatctgcaaaatggggttgctacagtaatccttgtgtcaggctgaaggatttaatgcagtgataacatgtgaagcacttaaccgtgtctggcactcagcacacagttcatggtaattattagtactctgtgacagtgatgatgataagtaataaactctggctaaacacagttcttactgtaaaccatggaaagctatgagaagaagaaagagaagaaaatggaatgttctgtgccagcgttccttcctgtgctttgaacttacatcttttgacctttcaaggtagttttgctcttcctgtatttggagtggtatctagtgaccacttctaacattcagccaatttggaggggcagtaagtgaggctggatgctggagaagaggggagagagtgatgagggaaaaagttgcctaaagtctgtcacccacccagtaaccctgaggtctgggagtcctgtcttgcaagtgtgtctggttggcccatgccttgctcctgacacttgggtcttgctgtgtctgaaaagtttgtggatggagacagtatctctgaacctttgtgaaacagtttttaactttttaaatgcatatattagaaaactgctgttaaaaagttaccctaagagaaaatacatccaagagctttgattgcagataatattcagttgcatgtctgaaaacaagtgaaagcgtatatttaaccataaaggctaattctcacaaattagctgggcatggtggtagacatctgtagtcccaggaggctgaggcaggaggatgtcaaggctgcgacgagctgagattgcaccactgcactccagcctaggtgacaggagtgagaccttgtctcaaaaaaaggaaagatgaattatcttcaagtcaccagcactttttttcaggggacgtctgccctgcatgtggggtggtggctccctatcagggacgtttgtcatctccctcagtgctctagaggcttaggcaggtaaagtcaagtcccttttacgtaaactttgctgtccagtgccagtccctgctggatgacaccaaccacgttggaataactgcaaaggccttccgcagtcagtcactgtcattgtcaaagtcaatttcaggctgctgtggttattcctgggggtaatcaataaatcatgtcatcaccttcacccttcacaaaggggggtgggcggagagaaggcacttcatcatcaaggaaaaagcattcccactgccagaaataaagtggaaaatgcagcaatcaatcctgtaatctgaagccttaaaacttaaacatcttcacaagatgtaaagtcacggctcagaagggggccaaaatgcataccaatacagatccctgcgctcactctcactcactggaggatgaaagagcaccacaggcttgcagctcattacagtacagagcacagccttaaatgaatgttccttgctcactgcaggatgctggtgtatgaatatgagttcgagataaaagttaagtggtcattggtactaaagattcagtagcacaaaaagttttttaatggtattggctggtgaggagttcctgtgagtcaaagacattttttctttatttctgttagaatagtagcacaggagatgtaggatatggcatgtggagagaaggggagaccaaaagaggtggaaacttatccattgagtagctagaagctctctctgtgatagaaatgtcacttgagggagatagatcatttcctattcctgaatatatgaacactgcagtgaatgcttgaaagaaagagactaaggaccaatgagaatttgtgtaattcatcccttcccttaaaatatttcaggacaaagaaaaaccatattctcttccaagtaatgactgaaaaaactggcgtcccaggaatcttataagtcatagtgccttgagttgtttacagctgtagatttgaatattaacatccttgactcccagaaggaaatcttattttggattgctcatgaccaaactatgtatgtatttaatacttaacttttccaaataagacattctgattagtgctctcaccctcccctccatagatgtggaaaaatcattaccaaaaagaagagtgatccacttgcttggggagaaaaccacttgtgtgtcggctgctgtgtctgatgagtctgtggctggagacagtggggtctatgaagctttcgtgaaacagtaaggattcagcaggggcgcttttagctccagcgaatctccatcgccgtggatgtgggttatatgctgtaaatggactgctaccattagtccgctctttggcttagtaaggactttagccgttaaagaagtggtgtgcctgaaaagttcagtatatcaaaaatgacttagccatggaaattatcgataaacagattggtgtacccagaggcaattgaccctctttagaatttaaaaaccttgaatttagtgggaatattggaagaattcaccagaccctgtttggcacatgaagcttctcacgtgtatttctgaaagtctgaaatgtctcaagggtgtggtatatttctagtaataaggaaagtagtcatcagagaggctttgccctaaagcccagaggcgggctcttcttgaaaagagcctctgaaacagtaagctttcgctgggatcagttccactgggagggcataggagtgctgttaatttggattttcattcagaatcactaagtggcaaactgttaaccataacaatcgataaccccattaattaactgttcatctactccctgtccatatagacctagtgaaatggaagatgtcacatacagtgaagaggatgtagccattgtagagaccgcccaggttcagataggactcaggtaaggaatgtacgtgggaaaggagcagttctgacatctgtgcagggcaagtggcctgtggtgattcctgacttcatttagcctctcttttgacagatacaatgcaaaaagttcaagtttcatggtgattatagcacagctccgaaaccttcatgccttcttgatacctcatacttcaaaagtgtaagtaaaatcagcgaagatcaaattgaggaacttaaacatttccatgtaagagaattttacactgtaatcatacagttcatcaaaatgaagatacggaaaagacatagcagggctgatcatgtctaaatgaatggcagataaagatgagaagggaaatgtgaggaagacatattgagttttaattcttactcaactgattctttctaagagtagaagccaagacatttaatctcttttttgtaaccagaagcactgttttatgctgtgttggaatttgattgaaatatgggtaaaatttttgtttttgtgtaattgttactactgttgtttaaggaattttctaatcttttacattaaaatgtagtgattaaattttatgtatctgtacaacattgccagtcaaacattttatcatgctacatgtaagagtatgtttttatcatcaagcatttacttccctgtgaccagtgagttcttaaagttatttcacttcatcaaaccaagaatcccaacaaagtgatgacataatgctacacagtccattgcttagagactttttgcttcctgacagataagcctaaagatctcatgacaaataagtctggaagtcttagacaccaccattcacattttctgacatcagagtttcagtgactctgaagggctcatggctggaaagtaccaggaagaatccagacttcgacttagcactatgacgtagaatccggaatatgcatgtccactctgcattgaaacttcctgtaagaagtggatcttaataatattttgaatatgcagtgcaaggctttggaaatttaaaaagagctgttgaggggtgatccccaagactctatacccagccaggtgaatgttttccttaatgatagagtatattccttagtgataagacttttaatagaataaattaaagagttctgcatgtttttcctacagagttgcttgtaagttcacctcctaacattccaataatcatcagaaagaagaaactggatctaagagaaaaagaactagatagaaattatgtagttgacaatagaagaatagagatagtggctttctttttttttttttaagagatggggtctcactgggttgcccaggctggtcttgaactccctgggctctcccaccttggtctcccaaagtgctgggattacaggcgtgagccaccgagcccagccaagatagtagattttaatgtgttgacaagcatcaaagctggaggtaggataggattccaggaggagggtgagcttagagaacttcctgaatcaaagtgtggactgtccacatcattagtgagaccagtgaggagagcaggcatcacatagaagtgcctagatcaacgcagagagcctgcttcccaaatgcgagatgaaaaacaccagtcagcggtgtccaggaagactggcttgatataaactgtgacttctccctaccagtagataagctgtgatgttggagcatgccattggtggccttttagtaaagcaaatcatggagaagacaagtctaccagagactgaaacaataaacagtgagaactaatgcacaacttcaggagaaaactacagaacaccccaagaacacacaccttctttaaactcactgtaagggtgcacctgcaatatgctctacttcaactaaaccaatcacagtcattctcacttacctcataggatgtcaccaagtcccttctggaggcatggtgatacctgcgtagtgtaggaccagtgaaatactcagcccaaccaatgagcagacatttgctcttcggctccccagctaatgtgcaggcacttgttgagttggtgcgaaccttcctgacatatatagcaatctttccttaaacccacatgtaaaagccttggcctaaataatgacactgctaaacatgacagctagtatgaaatattcttaaaattgttcttttttttcccaacctcaaaagttattttttgattattaattgtgacaagcagaaaagattttcttctgctgaatcttcggcctcccagggacagtgagctgtgtcttagtaaggctctttaatcaacagcagtgggcttcaggcccactaggttttcattgctgaatctccataattaatattgatatgaaatacaaaataatatgacattcctcagttctgcatttgaattacagtttttctaacggagaaaggcatgttttagaatctagattagacaagcctggaaatgggggtggaggggatagacttagcggtattctcttcctgggatttaaaggaagttacctcacgctctttctaagaattgtgggtcctcatacaatgtgtgctcagaagagtcactttaaggtagtattagaagttattgtttttctataactcttcctctgaattttacaaagcacgggactcttaaaacagtttgtcgtatctcagaatttggagatgctagacagtgatatttttgaaccgttgtttcatctgttttaaattttcttaacaatatgctactgagcctttctttttctctagtaggataatgtattccattcctgggaggtgatcatcagcatctcttgtttaatactcaggatgaggattctgtgagataaagtcaccagtatctacttagtgtgttcccaccttcccaggctcagaaataacttattttggaattggctgtccatggggcaggtgggacgttaaattcgtctgccctacggattttcttcctcttcactttcctatcatgtgcctttgctgcagtctcgtggtgagtggaggctgggccattgcatgctcaggggcgtagtcagctcgggtgggttaaggacagagcatctatgcagctgagcacggacccgtgatggcagcaacactttagattgatcttgaactccacgatccctcattttctctctttgcagataatttcaaatgatagctgtgaatctggtataattaaagtacctatgaaatccattttattcttgttctttgcagatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggtaggattcttcataattcccattaccaaatagcacttagattgggtggtctgaggatatactttgtagttgctattttgccagccctagaaatcactacagacctgcccaacatcttgggatacatctagtgtttgttcatttttttctgaagtagtggtttctgtttattctcttattccagacctttaaaatctgcttataaattgtgattttctgtaaaagttgctttctatttctaccttttcaccacagaagaactttacctttgtgacagctatcactcatggagtgtgcttaccactcccagtaccaatgccaagctttgcgtgactgctgtgtatatattatctcatttaatcctcatgacaacctgatgaaagattggttatgaaatggatgattatccactattttcagataaggagctgcttagagaggtaatatattcaacggtcatacaactagtaagcgatgaagccagatatcaaaaagatatccccacataattacataattcactgttacaaattaaaattaagcaagaccactgagtactatatagtacccttattcacctcattctcctccaccacagtattggagctttcgggaagatgtgatgttactgtttaaagcaatatgacatttaaatgctacagcagaagacttcacagttaactaattgtgagtttaatacactgttgtgcgtaataaccagaaaaccattatgtcccagtaaagttacataagtattcaaatgcaggcatctagagatgtgccatgtgttcagaaaacaatgtgagtctccaattgagcttttctctgcagtccagtgggaagcacagaaacacatgtttcatgatgaacaaagtttaagaggggtaggtttcttcttaatttttcttcttgttttctttacttgaaaaaaatatctgatgatattgtctgacaataaagttagaaagaagcagagctaacagactcgttaggctatcagaaaggctttagtatcatagatgtcatatttagtataatagatgtcagaggctcccacaaagttcataaatattatattgatagccttaaagaagagtgtaattgaatttagattttgtctatgtgtgatttggtggaatatggaaagcctttatcctttactttttttgccattctactaacttatgtatctaaagaaaactgttgctttttgatgtcttattcaagaaccaaagtggagtttttatttttttttcagtggataatgggttgtttgtgagtaagtcacctttacagcatattataagaagtactatgaggccgggtgtggtgggtcatgcctgtaatcctagcactttgggaggccgaggcaggcagatcacctgaggtcaggagttcgagaccagcctggccaacatggtgaaaccctgtctctactaaaaatacaaaaattagctgggtgttgtggtgcgcacctgtaatcccagctattcaggaggctgaggtaggagaatcgcttgaacccaggaggtggaggttgcagtgagctgagatcacaccactgcacttcagcctgggagtcagagcaagactccatctcaaaaataataacaataatttcacatttacataaaaggcatgcttagtcattaggtcttcgcaaaatggtatctcacaaactaatcccaggattagcttttaggttgggggttatttcttacttagtcacagctgaaaatataacatatccccatgttttaaaaaatccagcaatgctttatgtcaggagaattgtgttttttttaccctaaaacaagctcattcaataatctttattatatcagaacaaatactaatttaaacattttattttctcttccttatttttttttctttgttttctttcacttacataggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggtgagtcaaaattagagtataatatgaaagtaatgtgaaatacatatatgaaatacatatatgaaagtaatatgaaatatggaatgctacgagaccaacatgcttttatcactttcactgtccttccttttctcctttcacaactttgattttcccagcttcctaaaaaaaaagaaagttaatttccagctttgtttcaaatatggtttataaaaggagcactcttttctgctcacacttccttgtaaaaataaactgacataggggcttcactggttttaagtgatcatggaaaaaaccttttaatttaaatatatacttttcatgtattgtgttcacattgtttgattccactgtcaggttatacatttggcacttttatattttgcagatttgaaattattaagccaaaacagtgtgttagcttttcatttgtaacatcaatagccataagtattttctattaaatagttttgtgaaggccaggcgtggtggctcaggcctgtaatcccagcactttgggaagctgaggcaggcgaattgcttttgctcaggagttcaagaccagcatgggcaacatagcaagaccctgtctctacaaaaataacaaaaaaattagctgggtgcagtggtgcacgcctgaagtccttgctcctggggagactgaggtgggtggatcgattgaccctcagaagttgaagctgcagtgagccatgatcatgccactgcactccagcctggatgacagaaagagaccctgtctcaaaaaaatgggggttaggttgtagccagcaaccatacttcaatgtagtacttcaaaaaatttacaaaggggccttttgtgaggccgttcatcatgaatttggcatttgtggttattgttattgagttcaagtttgttttagattatgaggaaggcatttcctaagcagaagtcagataattaaacaacagtgttttatggatcatctactgtgtgtgagaaactatagtagacactgtagtgggtggtgaaagggaaacaaacataacggtacattttagattacatacccaggcttgtgatagacactgaacaacacatacaaaatggcaaaatatgatgttttatccttaagaatgcttttacaatggtcacactttatgtaagttcttaaaaatagctttattacaatataattcatacatcatacatttcacccatttaaagtgtgacagtttatccatttgaagcacccaacccagtggtttttaggatattcacagagttgtgtgtgcaaccaactttacagtctaatattagaacattgtcatcgtcgccaaagaagccctgtgtgcacgagcagagactcccagttctccctaacctctttccccaaggcaaccactaatctctactacaaggcaaccactcatccctgtctctaaatttgcttcttctggacatttcatgtaagtgcaataatacaatatttgttcttttgtggcatctttcacttagcataatattttcaaggtacctccatggtgttgcagtattaatattttattcctttttattcacacataatattctattgtggatgtaccacattttatctgtccgtcagctgatgggcatttgggttgtttccactttttggctattatgaaaaatgcagctatgaacatttgtatacaagtgtttttgtggacatatgttttcatttctcctgggtaggtacctatgagtagaactgttaggttgtatagtaactttgtgtttaataatttgaggaacagccaaactgttcctaggtgtttgcaccattttgcattcccatcagcagtgtatgagggttccagtttctcccttgccatgtgttatctgtctttctgattctggccattcttgtgggtgtgaagtggtgttttcactgtggctttgattgacatttccctaatgactaatgatggtgagcatcacagccttattggccattagtatatcttttttttgagaaatgtcttttcacattctttgtctatttttaaacgatgttatttatttatttttaatttattatcattattttcttttgagacggagttttcttcttattgcccaggctggagtacaatggcataatctcggctaaccacaacctctccctcccaggttcaagtgattctcctgcctcagcctcccgagtagctgggattacaggcatgcaccaccatgcccagctaattttgtatttttagtagagacggggtttctccatgttggtcaggctggtctcaaactcccgacctcaggtgatctgcccaccttgcctcccaaagtgctgggattacaggcgtgagccaccgcacccagcctgtttatttttttattattgacttataagagttccttacctattcttgatgcaaaccccttatcagataaataatttgcagatattttctctcattctgtggattgtcttctcactttcttgatggttttatttacagcacaaaagtttttaattttcctaaaagtccagtttatccatttttcaaaaatccttgtgcttttggtatcatagctaagactgctttgcctaaactaatatcacaaatatttattcctgggtctttttctaacagttttaaagtcttatatttaggtctctgattcatttgagttgttaacgtggatccagtttcatctttttgtatgtggatatgcagttgtcccagcaccatttattgcaaaaactgttctttcaccttgaattatcttggcacccttgttgaaaatcaagtgtgagggtttatatttctggactctcaatcctgttcattaatccacatgtctgtacttaagctagtactgcactgctttgattactatagctttgtagtcattttgagatcaggaagtgtggttcttccaactttgtttttctttttaaagattattttggctattcagagtcccttgcatttccataagagttttagtatcagtttactaatttctgcaaaaaaagatagccaagattttcatgggggtagaattggacctgtaggtcagtttggaagatactgtcatcataacagttctaagtcttctgatccatgaacataggacgtatttccatttatttaggtctttaatttctttcaataatatttcatagttttcagagtcaaagtttgcatttctttcatttttcttttttatttttatgtcagatgggtaatgtgctgatgtcctaatgagatttgaaggaggcacatgtcacacatgagcatgaaaacctaatcatcacacttaggaactacaaaaggatcagtatgcgacttcttttgttaaacttatttctaagtattttattgtttctggtgctattgtgaatggaactgggcttttaaaagttttgttcatcatggccccatacaacaacatgaaaaagatctatactatgaccaagtgagatttatcctaggaatgcaaggttggtttaacacttgaaaatcaataagttatatcagatatttaatcatttaaatgttttaatcatttaaaacaaagtttgaggacccactgaaacagtgtgatgtttcagtacatgtattcattatataatgatcaaatcagggtaaattaacaaatccatcacctgaaacatttatcatttcttgtgatgagactattcaaaatcctttcttgtagctgttttgaagtatgtaatacaatgttgttaattacagtcaccttactgggcattagaacagcagaacttattctgcttctctaactgtaacttgatgttcctgttgaataacctttcccttttcctcctcaccctccctactctctccagccactgtggaactgttttctcagttgcatttttaagtgtttgttgcacagttgattttatcttgtatcctgcaaccttactgaactcatttattaattctaatagtttttttagtggattccattagattttctataagatcatattgtttgcaaatagaggtgattttacttcttcctttccagtcatatgccttttatttctttttcttgcctatttgccctggctagaacttcccagacaatattgaaagaaattgtaagagcagacatccttgtcttcgtcctgatcttagtggaaaagctttcagcctttcaccattaagtatgaatttggctgtggctttttcatagatgtcctttatcagaataaggaaaagctcttcttttccaagtttgttgactgcttttcatcattaaaggccgttggatttgtaaaatgcctttgttgcatctgttgagatggtcatgtggtttttgttctttattcaattgatataatttattaattgattttcaagtattaaaccaaccctgcattcctaggataaatctcacttggtcatagtgtagatcctttgtatgttgttggactcagtttgctagtattccattcaggattttcgtgtctgtattcatagtattcttgtgatagctttggtttttatcacgctaattctggcctcatagtatgagttagaaagcattctaccttctggaagagtttgagaataatttgtattaattcttctgtaaacgtttcatagaattcacaagtgaagccatccagtcctgtacttttttgtgtgtggaattttttgtttacagattctatctctgtacttcagtctatttagacttagaagtattgctttttgagtctgttattaggtaaagtaaatttagcatttacctttagcattgcattgcatctttctgttcaactgaaccttttatcattataaaatgttcctttttattgctagcaatacctcttgttttaaaatctactttgtctggtgttagtaaagctacatatcagcctttttgggttagtgtttgcatgatttatcttttttcatccttttactttcaacctttctgagatattatatttaaagtattctacttataagcagtatgtagttggttttgtttcattatccagtcttaaaatcttcatcttttaattgaaatatttaactcatttacttttaatgctattattgatatatttgggtttgatcctattatcttcctatttgttttcttttaattccatctttattctttttcttccttgttttgaattatttttaaattttcgttttcccctctactagatctgcagtcttttattttttgcagtttccctggagattatagcatgagttcttaacttattaaaaactaccatgaattcctttactttttcccagacaatgcaaagattttcaaagactttaactccattttattccctttcctccttctctgctattattgtcatatattttgaatctcacaagatagtattattgtttcattgacagttagtattcattcagatttcctcacgtttttacccttttgttatattttatttccttctgcattattgtgcttccatttgagacattttgcttctgctcaaagaattccctttaatatttcttttagtatagacctgttagttatctatttcaacttcatttgtgaaggatagtttttttgctgcatattcagaattctaggtctgccgttatttctttgaacgtattaaaaataccattttattgtcatctagcttccattgattctgttgagcttttggaggacaacttaattgttagttcatacagcatcatttcttttttattattattattattattattatactttaagttttagggtacatgtgcacattgtgcaggttagttacatatgtatacatgtgccatgctggtgcgctgcacccactaactcatcatctagcattaggtatatctcccaatgctatccctcctccctcccccctccccacaacagtccccagagtgtgatattcctcttcctgtgtccgtgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcgtagtattccatggtgtatatgtgccacattttcttaatccagtctatcatttttggacatttgggttggttccaagtctttgctattgtgaataatgctgcaataaacatacgtgtgcatgtgtctttacagcagcatgatttatagtcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctatgcagaagctctttagtttaattagatcccatttgtcaattttggcttttgttgccattgcttttggtgttttagacatggagtccttgcccatgcctatgtcctgaatggtaatgcctaggttttcttctagggtttttatggttttaggtctaacatttaagtctttaatccatattgaattgatttttgtataaggtataaggaagggatccagtttcagctttctccatatggctagccagttttcccagcaccatttattaaatagggaatcctttccccatttcttgtttttctcaggtttgtcaaagatcagatagttgtagatatgtggtgttatttctgagggctctgttctgttccattgatctatatctctgttttggtaccagtaccatgctgttttgtttactgtagccttgtagtatagtttgaagtcaggtagtgtgatgcctccagctttgttcttttggcttaggattgacttggcgatgcaggctcttttttggttccatatgaactttaaagtagttttttcaaattctgtgaagaaaggcattggtagcttgatggggatggcattgaatctgtaaattaccttgggcagtatggccattttcacgatattgattcttcctacccatgagcatggaatgttcttccatttgtttgtatcctcttttgtttccttgagcagtggtttgtagttctccttgaagaggtccttcacatcacttgtaagttggattcctaggtattttattctgtttgaagcaattgtgaatgggaattcactcctgatttggctctctgtttgtctgttgttggtgtataagaatgcttgtgatttttgtacattgattttgtatgctgagactttgctgaagttgcttatcagcttaaggaggttttgggctgagacagtggggttttctagatatacaatcatgtcgtctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagttcttgcccattcagtatgatattggctgtgggtttgtcatagatagctcttattttgaaatatgtcccatcagtacctaatttattgagagtttttagcatgaagggttgttgaattttgtcaaaggctttttctgcatctattgagataatcatgtggtttttgtctttggctctgtttatatgctgtattacatttattgatttgcgtatattgaaccagccttgcatcccagggatgaagcccacttgatcatggtggataagctttttgatgtgctgctggattcgttttgccagtattttattgaggatttttggatcaatgttcatcaaggatattggtctaaaattctctttttttgttgtgtctctgcctggctttggtatcagaatgatgctggcctcatcaaatgagttagggaggattccctctttttctattgattggaatagtttcagaaagattggtaccagttcctccttgtacttctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgagcatcattccttttactgcttgtaagattcttctttttctttgatttttcagcagtttcactctgatatgctaatgtgattttctttttgtttataccactgaaattctttatcatttcattcagttattttagcatattattcataaaaacttaaatttttctctcaatgcctttagtgtatggatcatctgtgggtttgccttatttagctattgtttttcttgactttcactctttagttcctaatgaaatactggatgttacgtatgagaataactgatatcttcctccagagaggattttctattcttctgaaaggcaaatgacaatatgggtagcttacctgaatcatgtggggatgtgaattccagttttactctccataagactgaatgggacaatggaaatatctgcttactattttagcctgatagcagctgtttttttttttttttttttttttttgctttgtttctcagcttcttgctctgcatataggcagcttaggaatggcaaatgccatgacaggaatatcatgtagaatattgagctcactttacagttcattttctctaacctcttgtgagttgactgccttggtagtcctgaactcaattttagtcttcatatcctactgacactgccactgttctaggcagccacagtctgtttagcccatgtacctcaccactagaattgacaaatacgctaagggaaaagagtggccatggctcaccttattatatttctgttctacctgggatcttggccctctagtcctgattgcctttgttgctcttcattgctttaaaacatctgagaggttttgcttgttttgggttctattttattcagctttcatatttgttttcagcaggagagttgagtcgtctttacagatagaagtgtaaattcccatctgctgagtttttaagtcattttttcaagtatattatgttaattgccgtatgctttacattcttcaggatgcagtgtcagccttacttgcaagaacatcagctgagttgttagctgtggaacaagaattagcacaagaagaagaagaagaatcaggacaagaagagccaaggggcccagatggagactggttaaacacttatttcctttgctgttgggagctcaaagatgatgtgtttacacggcttacagtgaaacctttgtaggctcatgctttattccagaatgatggaatgcactgcaccttcaggaagctgtgctaggaaaagtctttccttggtcattagagagttaaggaagtaatggcaagattatgggcaaagttaaaacattagccagattctttgttcttgtttcgagtaattttaaaacactattttctgagcctttttttttttagtctaaacttgattttgaaaggtatggtagcttattgtagagttatagataattttaaaagtgactctatttttcttttaactacctggaagtaccatttaggctctagtaagacaaagcaggtatttaaaaaacaacttctgagtactcatttctctgttaccactcttaccttctttttctgtgtccttccctgtatccatacccaatcctttaaaaaggggaggcagagggggaagttattacagttattgtccaggttcatttatatataaagagctctccttcctggattgtactgtttctcttaaaacaaattttagtgaatatttcactttttaagtatatatgtgaaatcatttgagttaatttttaatatatagttgtttatactgttatgtttggttgaactactgttaatacatgtgcatatacatatatagcatgcatttgtatgtgtgtatatagaaaactttttagaaacttagagtgacacgatatatcataaataacgcagtcatggacatttggaaggaagagcttctactgtgatgtaaaaagatatagatatactttgtccttataaaaagtccttcatagtgaataaaaatcacagcactgcaaaacaaataaatacgagagtgattataaggttcattatagtatctttaaatagtaattctcatatatgtaaaatacaagttgtttcacacatatttccaaacagtactcttaatatgtaaacaaaggaatttataactcatagtagtcattaatggttccccttgtgttcacttcatggctagacatttattaactagtctgtgccagtttgtcattatgtcaccaatcaaattaaagctgaacatttagttatcaatggaaagaatgtctgcattcggagaacatgaaactcaacaaagtatgagatgttctaaaccatcctagtactcctgctttatatattccatataagctgtatttatattctggagcaccacttataccacttataatgccacttcagcccatgccagggcttttgttaaaaatgagccttctgctagttcagaagaaaaacttccttaacgtaggattctccctgctcgactgtgagtacactcaataaaatgaggatttaaaatccttatttctgtattcactgtcatatgattaattttacaataaatgaacaacgaataccaagttattttatagtgagtgtcaatatttttaaatgctaacattaaactctataatgtgattttcagaatatgtctattttgatatctagaagttaggttaaatttcatgagtttaactttttagtaccacattatggtgattttgctgcaggttactagagggtgaagagaggatttttttaaatgagacatttagttaaaaaccccagccaaagaaatggcttggctcattgtgtgagtctgtttatttcccagataacaacttagcatgcccaggttgcgtgttcatggagcatgcctgcctaccaaaagtgttttgtttttgttttaccataggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggtgactattccgctgtgctgtcttaaaactgataccttacaggcaccatgtggactagggagatgcttgtttgtctccttaggtgtaaattccatgtcaggattttgtgccaaaagctgatcgtgaaaggcatatgtgggaataggctctaagaagcatcataaatgctttaacgttttaaaatgggcccaagatattctccacttatatttggagaatatataagaagagaaatagtgctagttactttaaatctataaatattctgtgaatattaaaagtattttctgaattcctaggagaacaacagggtgtcttgtgtcaagttccgtatatgtagtaagttttatttccatttcaaacatgaagtaaacatttaaagttcattttggttaggcgatgccctgattagaaaagtgacaggtgacttagtttaggcacaagtgccaaccaagttattaaacaggtaactttgctagttaagtgagagatgtattgagactgtcaaccccatatggggaaaatattttcaagcttcatggatgctcacacactggggatattggtagtagagtttagaaaattataattttgtattcctgagaaaataatattatgccctgagaacttcctttctcaaaggagcaaactttcatcaagaggcaggtttggaatcaaattatacctataagataaaaaatagacatctgcctatgcctactgagtttgtattttgagaaacttccatttttacttaggttttatttttgttacatttctaaagatccagtaaaaatacaactcagcttcacaacagttatgtttatacatgtataattgcatattctatttaaacctacaagtttgtggtatatttcattttcttatatttaattatctttatcatttatttggaaaacaatgtaatcagaaagttgaataaagtttaatgatgatatgtacccaaataggattctttatagaatcactttaaatctaaaccttcatttttatgttcaaccctttggaggcagcacctctatttatggtgcttgttggacagatatcacacggcctgctgtgcagaacttcctaagaacttagtacaaaaccattcttggtagaaaactgaagaacaattctccccagaagtacttcagaagtactatagtctgtaatgcaaagcctttctcttaggagtggccatagtgctccatgagtctctgttgtaacattagatattttttctttcttagaagaaaggagcataatgtttacacatctttcagctcctgacaaattgttaacttctcttataggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcagggtaaggtggcagtgctcgtggtgaggcgctgggactgcagcttcttccctgctggtagggagtggcctgcaaaggacaagagactgtgcactgggagtccacatgacaacgacaaatgctagaaatgctgtaaaacagatgtagaatatcacgtgcttatggtcccttttagtttgtttgtttttccatcaaatttaatgcctccttggttccaatgtgatttatttggcaagtaagcgaagtttaaggatctgagtgctgagtatttgtacgttatttggacttcggtctgtatttagaaacataaagtggttttttgagatacatgtggtctgtatatttctgttctatatcatatgtccttcaaaccatgtttgtcttgttgaactgagaactgtgaattgcattttagattaaaaatcctcttttaataatgcttataaacactgaatcacatccatagttctgtgaagaaaattatgagatttgtatcagtttgccaaattctacttctagaagtatttctgatttatctagtaagatagacataatattataaactgggttagaaatactttttaaattctaaatttattcattcagttcaacacatttttattaagcacctgcttttaagcattttcttaaatacttgggattcatctagaaacaagagacccagagccctgccattgtagagtttacattcctgtgaatcgagccagaccacaagcagtaaataagatgaacaagctatgaagtatcttggaaggggatcaatgctatggacaacagtagtgcagggggttgggggtgatacgcaggattcagagcaggctgcatttcagtaaagatttgaagcagatgagacagtgagtgtgggctatctgggccgagagcgttctagatagcacagactgtgtctcaactctgaccttgagctctgcttcatgcagacctttctttaaagaaacaaatatcatgtattagctaaaaatacaaaggataatttcatttcaaaaaatatataagtaccttaaacatatgatttttaatagccactaccaaaaggcagctattcagattatttgcaggcacagtggctcatgactgtaatcccaacactttgggagcccgaggagagcgaaacacctgaggtcagaagttcgaggccagcctggccaacatggtgaaaccccatcctactaaaaatagaaaaattagctgggcatggtggcgtgcgcctgtaatccgagttactacagaggctgaggcaggagaattgtgtgaacccaggtggcagaggttgcaatgagccgagatcacgccactgcactccagcctgggtgacagagtgagactctgtctcaaaaaaaaaatacataaataagtaatttaggaaaatgaagttatttaacaaaatagaacaggaaaaacttgtttgaggggattttcttaaagaaataaactcttaactatgactacctgctttacttggtaaatgtctcaatcccaaacttccacttgcactctgtttgatatgcagtgattttttttttaaatcttttgttgccagttaaatcggagtgacagtgacagttcaaccctggctaaaaaatcactgtttgtgagaaactccaccgaacgccgcagtttgagggtcaaaagggtatgtattccctcagccacgtcccactgtccctggaccagtccagaattgtcacttgtgcagcacaaactccagaactacagaatgaatgtcagtgctccatgcgcttggcctactgaatgcagccactgggatacacagagacgcagatgccatggccactatggagatgggggggtgtgagggcatttattcatcattggtgtggaacctgtgatggttaaggctggaaatgcggtttcagtatctctggagaaggggccttctgagcctgcaggggtatcagacgatggtagaacacatttctgatgactctgcataccatgtccaggtcttgagcgattgtgggaaggggtgtaagacctggtaccttttctgaaggacacacattctggtaaaggaggaacacacagtttttgtagcttgcttacacagatatctttagaaggttaaaactcatgtgggtgggcagctcgggtggcattttcctggaggtcatgggtctctgcatgagccttaaggataagtctaagagaataaatgaattaacaggttggtctgttcaagtagttcagaaattcctgtttacttgctaacagctgaaatactaaaggaaaatatttgtttactgtgatcattttggcttaaaatgtgtggttcggtgactacagagcaccacatgtgctgagctctgttgacggcgaactcacaccctcaggagtccatggtctagaggaggacacaacacacacaggactgtcacaactgtgccgggtatgacagggaattagcccatctgattgagagtcagaagggctcagttgacagcagttggggggtctccacacttgaatacaatttcaaaaagaaaatggtagctttggggcagggtgggggtgtgatggatactgggcgctgtgggtaggtggcgtaaaatgatacgggagcagggacacacggcatgaggagtgtcaggttctgccagcagctttggcactgtggacgggaggatcaggcatgatggctgggaaggtaaatcagaagcattgtcatcaccagggccactctggtctcattctgccatgtgcagagtaagagatgcctggccaggcagcagtgggcgcccctggtttaacttccttgttacttgaaaggcataaaagaatattttgtttttctaaaggcagatgagatgtgctagcatttattcagcattcgtcattttcaggaaattctgaaatgttgatttttcaggttaccaaactttatgccttaaaagcacctaaatttttatcatcttgaatgaaaagtcttctcaactcctttctaagtcacctgccttcttaagcagctcatactctcaggggatagtttcactcttcagataaatattaaccaaaagtgtttatgaatcgagtggagttgagaaacggttaggttactgataaacttagttattaggactacttgaaacagacaaaggttaatcctgaagcatatgtaggagatggttttaaatggtttttaaaagtagacagatatggtttgataggaacaagtggagaatggtattctgctttaggaattacagcataagcaaggtatagaggtgtatgaggacaaaagtatctgcaaagatgaggaaaaggttcatctgaatagaagaacaaagcgccaagtgtgtgagtgatgaggttagaggggtaccgaccggcagaggtgtgctgcaccctcctcacgctggctcacaagagccaattgtgctcgtctcttgccagttaaatcggagtgacagtgacatcacagtcatagcttgaaaatggtgatggtaggagtatttaccacatagaaactggccaaccctacaagtcagtgctttcttctctcccagagagagccagttattaaacatttaccagcagactcttgtatgtggagtccttaggctctgtgtgcatgacagctaggaaagatttctgattccaaaaagtaagtaatacagtcaaagataatgtgtgtctagatgattcttactgtgtaatgcatttgtagagaggagagggtacaggttgaataaagggaacctaataagaagaatgttacagaagaccatgcagtatgtactggatgtggaggaagaacaggaggacacaataagagtgattctgacttgggctaaggctctgaaatcagcatagggacagacaggccccctcccttccatctggcatgagcactaccattattttagatcttcaaactggagtacttgtcaaatttgagtccctcctcgctcatatcaaatagtaacagttcttattagtgatcacttattttgcattctgtctgccaataatctaggcaagaaatacctccgtgttcccctctgctggtagagtctcacctctcacccagccttgtttaaaatcccttcctcaagtgcatgtgccctgaccctgagtgatccatccccttccctgacttcctgtgcacttctgcactcactcacagcttcctctcgcttaaggcctcatgtcattctgcagccgaagttttcaagggcagagattgtgtcttctcttcctagtactttgcctgcacagccccagcagacatttattcatatatgttcaataattattgcttgatgaataggttaagattgcccctgggaagagccatggtgattcagtggtgaaagtaagtagcacacaatgggaaatcaaggaaggcaactcagtttaagcattctgattggaggagatagtcaaaacttagcaacactgtccagctgtattcaggctgactgtcatggacatggtaggagttatgtgtcctgaaatggaggaaacagaaatgtcttgcaatgtatttatttattacactaggcgggcttcatgcaatcagttggtcaggctaagtaagccaggctgtactatggtaacaactttaaaaatctctgtggtataaaacaataaaggtttatttcttgcctagctactggttcactgcaggttggcaggaggtcctgctccatgttgctcttacccagggcccatgctgatggagcctccctctgtggttctttgctctccctccagcaggggacagaaatgtgcacctctcacactggccttgacagccttctgccagaagtaaggcatgtctctcccactcacctgccatgggccagagcgagttgctcctgccccttaggccctggcttctagggtgcaaggaagcaccatccatcatgcgccaggaaggaggggaagtggggtaaccactgcctgtataaccagggtgttcgtcattccgtttctaactatccagacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggtacgcagctcagggtctgtcatctcggaggggcttacatctttttttaaagcgtgccatgtagaaggtacccaacttacacttctgttttgcgcataagtctttagatgttttactacagcttggaacatatttttcccactgttataggcccttttttttttttttccaaaccaaaaatgttgaaggaacaaggaagctgggaaggtgggtgtggcagcaggggatgggcgtggccagtagggtgagggcgtggccagtgggggtgagggtgtgcccaaaggagaagtgggaagtagtcataatttctcctccatattgttctccatcttaacgtaagacttgacaaataaatgcagtataaattttggcataagtgggacattttgtttggattttctatagatatctttttaaggttcattaaccacatcaattgtgaaatacattgctaattttaatgctactaaattttcactttcattcttatcttaaagaaaaattacattttgcttattgacattctcccttacctttcaccctacaaataggtatactaaaaaaagatgaaatcactgattaaaaaatagagtatttttggctgggcgcagtggctcacacctataatcccagcactctgggaggccgaggcgggtggatcatgaggtcaggagttcaagaccagcctggccaagatgctgaaacctcgtctttactaaaaatatttaaaaaattagctggacgtggtggtgtgcccctgtaatcccagctattcgggagactgaggcagagaatttcttaaacgtgggaggtggaggttgcagtgagctgagatcgtgccactgcactccagcctgggcgacagagtgagactccatctcaaaaaaaaaaaaaacagtatttttaaagaaactatttccattattttggcacctacatactactgaaattttcaagaatctgcatacatatgaaattgatttactttctcaagagtacaatttatattttggtttaggattgtgtattcatatccatatgtagtagcaaatagaattttccacatagctgaaatactaatattacaaatgccaaaacattgttttctatcagtccctttggatgggaatgtaaaatggattagacacttcctgaaactaacagaaaatcttgtctatgatataaactgctctttttgacccagagttgttatttgatcatgtcatgtatagtactgtcaggaaagtgtgaatcgtccagctgactggaactactgatccttgatggaactcagaaactaaatgaatgaatttcaagaatcaaactgacaccagtaataaaactttaagcaacaaaatgtattacatgtatctatcttatcccacctgatagaaggaaaccttcacgttcagtaggaccggtgtttgctcagtgtggagtttaatgttaggccttacatttgccacagcagtgaatacaggataattaggcactgtgctggtttcataaaggagatgagccagacactccaggtctacgagagcagtgcttcctggggaagtcatgagaggtttcatggaggaggtggcacttgaactggcttttaaagtgggtagtggagcttcacagcggggagaggcccaggactctccattagtaaaggtccagatgggctccagacaatggagggctgtgggcaggagcctgcaggagagtagggccacagcaggtggaaggtagtcttatgaaatggaagattgaattacaagcagaaatgacctgctcttagtttgtaatctcaataaccaacatttttactctcttgagtttttaactcaacattaccaataatttcaaacttttggttgactttgacctactttactgtcatggagaagcatcacagtctttgactgttatgggtcaaagccttccaaagctgaattggagttttacaactatagatgcaaacagaactttgtgtctttggttgtttcttcatttctagtgtgtcatgatatgaaattctaaatttctagatatcaataattactaaaactataggacttaaatttttttacttaatatcataacgcaaagtttcatccataaattgcatttcattttttttgactgctatctaatctccattgtatagagagaagctcagtagagcaaaaagttctttgaaaaaaatgaaaggaaaaacaaagctctggcaaaattaatgaagagaatatacaaataaagaatgttataaaactaatgagggacagaactacaggtaaatttgagatttaaaaaataattacagctgaggtgggagaatcacttgaccccaggagttggagaccagcctgggcaacacagggagaccttgtctctacaaaaaaaattaaaaaaaaaaaaaattcactaggcatggtggcatgcacctgtggtcccaattacttggaaggctgaggtgggaggatcactttagcccaggaggtagaggctgcagtgagctgtgattgcaccactgcgttccagcttaggtgacagagtgagaccctgtcaatcagttatgaaaaattaaaaaataaataaataataaatgcatacacacaaacacacagacacacacacacatactcccagtgctttgggaggccagagtgccgagagtttgagaccagcctgagtgacataacaagatcccatctccatggaaaaaaaaaaaaagttagctgagcgtggtggcacacagctatatagtcttggctattctggtgactgaggcaagaggatcaccagaggtatgaggttgaagtgagttatgatcaccccactgaactttagcctgagtgacaggaaaaaacagttgaatactatcaaaagtatatgcctacaatttggacatacgtctaggaaaatctactagaatggatgtttggaaagaataaaaaggatagaaaatcctataactctttaaaaaaaaaaaatggaagcagtgattaaaaatctatccacaaagaaaatataagttctggatgctttgtacaaattctgccacactttcaaaaaagaaattacctcaattttatacaaactcttccggacactagaaaaagagagaacacttccacaactaattttatgttaatgccaacactagataaagattctatcaaaaggaaaatcgcaggccaggccagtttcatttatgagtgtagatgcaagaatcctgactaaaaaatattggtaaacagaatccaacactgtattaaaaagattgtacatgttgactatgttgaattgtacaaaggttttgttttctttggtttggttttttgagacagtgtttctttcgctctgttacccaggctggggtgcagtggcacgatctcggctcactgcagcctctgcctcccgggttcaagagattctcctgcctcagctggagagtagctggggctacaggtgcacaccgccacactcagctaatttttgtatttttagtagagacagggttttgccatgttggccagactggtctcaaactcctgacctcaggtgatccaccaacctcagcttcccaaagtgctgggattacaggcatgagccaccacacctggcaggttttttaatattagaaaacagtgaattaaaaaaatacatgttgaccatgtcaaaatgtctaagaaaatttttaatactaggaaatatatttatataattcattactttaacagattaaggagaaaaatcatttggtcaactcaatagattcagaaaagtattgagaaaagtcagtgctccttcatgtttaaaaatcccagtaagttagagacaggaagctcctcaccttgataaagaataacttaaagtaaatgtgatcataaataggtaaacattagaatcactttctttaaaatcaaacacaagacattcaatattcttccattcaacattgtattaggagttcctaaacagtgccataaggcaagaaaaaaagtagcaaaaagactggaaagaaataaagctgccattatctacaggtgacattgcatgcattaaaaaatttgtaagttattataaatagtaagagtttagcaaggtgggtgaatagaatgatatctaaaagtctgttgcatttatttacaccaaccagaaacacctagacgtttaattaagataattacaacagtatcaaagaatatcaaatatcaagaaataaatttaacaaaaataaaccgtacagtatagagaaaattacaaaacttagaagaaatgtaaaagcaaattcatggagaatttattacatccatgtagagcaggggtctgtaagcttttcctataaatgaccatatattaaatattatatcaaattatactatgatataatgtaattgtattataattaaatattaatgttaaatattctaggctctgggccatatgatccctgttgccgctattcagctctgccatagataaaatggaaataaatgatgtatttgcattccaataaaactttatttacaaaaacagggcaggccatagtttgccaactgctgatacagaggaagaattaataatgtggagatggccaattctttctaaaatgtaccatagagtcaatggaattccaagcagaatacccacatggttcttcatggatactgatgcagttaatgaaaaagtaaaggtcaaagaatagccaaggtactttggaaaagaataacaaggagagggacttgccctacaaatttattaaactgctaaaatagtgggaatttgtggagaaattaagagattggtcatggcatgaatacagagctctctagaaacagtgttgctgtgtgatgagggtggtatctgtgtggagtattgatgtgtgatgcataagtaataggggagctgtgaagtttctaaagtgttctctggaaagacagtgtggcagtagtataagtgaccatggctagagccagaggctccttcctagtccccagcgccagacattttctcatgagataaagtgagagagactttggcagatccgaacagtatgtctaacactgattgaaaaagaagatgaagaccttctttgaaaagtaccataaatatactgttttcctgagtgttttttttttattgtctttcattgtagaattctgctaagatttttactgttgttgatgaatggttcaaggtttgggggctgatagagtgacctttgttttctcctacactaaagaaatgtttggatttgctctaggtaaagtagatgtaaagtaggagtctagaacccaacaacccaaggaaatcatcaaggcagacacattgctcagagtctctgaaaactggcaggcaagtaagagttgatgtttgaggcacacatgttcattttaatgatttgtcctttaatgagccagtcaagaagtgtgtttgtttccagctgaaaaaaaaaattaagaaggagtttcttgggaaacttgagcagacatattttctgtaaaaacacacacacacctcctaatgaaatccttcctctcgaactcctatgctccttcagcctggagtgtaaactccctagggaagcagcgaggctactttttttcctttggtattccactgccttagaagatgttccatccaaccttggagaagtcccctttgcctcattcaagctgctcatcttgttgaccagccatgattttagcccttttttgagttttgcttgtctcctgctcaccactagaatagaggatttcaccctggggcttactggtgaatagatcaatacagcctgtaaaacgtgatgagaatctgactggtgggcactgtctgtggccttagcgtagcttggccatgtgagggcccctgccctgtcctcagggaacccttggtccagctgtgccttggtgacgctgggaccaagtttcaggaatatcagggtctagggatattatcagatcaaatcagtatttcttagagaccttatgtacaacacagttttgaaatcaaccctcaactcttttggcagactgttctgaaacagttttctgctgtttttgttcccagcatctcatacgatgttcacaggcgtaatctaggaaaagaatggcagcgcgagaggaaaggtgcccagttcattcttcccagggtgccgagatccctgacaccccttgtttgtttgttttcgtccctatctaccgacctatcattctgttctcagtgacagaaataatgataggaatgtgaggcatgtttctcagacatagtgtaaggttgaactaaattgccttgtaagtgacctctttgggagctgtcatctctgtcattcagtgcaaccaagtgtgtgacatgggtggtatttttcactttcatctcctaattgtcagcatttaattattcctattgcagggcaccgcctaaaaatgatgctggctaacatacctgacgggtgccgtcacttcctgtgcctgcctcagagccagtgtcttcataaaggtgctgccatagctgggtgagggttttgattcttttaaaatgtcaccacaacccaacatacttgtgtacaaagccaagtgaagttggccttgccagtagaggtaacattaatgccacattggttgtattttgctcacaaaacaggccttctggcacccacatggcagtactctcttagatggtgtaaaaactggtcgcttgggctcagaactgcccaggaataattcgaagatcatgggactgttcaatttggatcaagagtgcaaagatttgagagagccaagatctcctttgttttgcccagtgaaggatacaagcaggccttgttccagttagaaactgtctgaaaaagagtgacactttagaactctcctttgtaaaatagtgctttattttatattaatttgtagttgttcagtcactaaatgatacctgtgcataattctggccttgtagtaagtttctgacgatgattagaatcatccttacatagatgatcttgcttagaaattatttcttaaggccagtcacggtggctcacgcctgtaatcccagcactttgcgaggccaaggcgggcggatcacgaggtcaggagatcgaaaccaccctggctaacgcggtgaaaccccctctctactaaaaacacaaaaaaattagcgaggcatggtggcaggtgcctgtagtcccagctactcgggaggctgagacaggagaatggcgtgaaccccggaggcggagcttgcagtgagccgagatcgcaccactgcactccagcctgggcaacagagcgagactccgtctcaaaaaaaaaaaaaaaaaaaaaaaaaaaaaaaaaaaattatttcttaatagaggatttctttttgagacagggcctctgttacctaggctggagtgcagtggtgtgaccacagcccactacagcctcaacctcccaggttcaagcaatccttccacctcagtttcctgagtagctgggaccacaggcagacaccaccacactcagccaattttatttttttgtagaaaccgggtttcactgtattgcccaggctggtctcaaactcctgatctcaagcaagcctccctcctcggcctcccaaagtgctggaattgcaggtgtgagccaccacacccagcctagaggatttgtgatctttattatctgatgaaccagcacttagttggttttaaaattagtttgcataccaagataatgagggaaagaagatcctaaggatctttctgttatgattgtggtagagcctgagataaacacttttttttttttttttgacatggagcttcactcttgtcacccagactgaagtgcaatggcacaatcttagctcactgcaacctctacctcgcgggttcaagcagttcttctgcctcagcctcccaagtagctgggactacaggcgcgcaccaccactcccggctaatttttttatatttagtagagatggggtttcactgtgttggccaggctggtcttgaactcctgacctcaggtgatctgcccatcttggcctcccaaagtgctgggattacaggcgtgagccaccgcacctggcctgggataaacacttctgttctactgcttcactaagagggtgcagcccaggggagctgaagagagacaagggaggagatggccgctagtgtgctgcctgcttgctcccttgggaccagcacccaaaggccatgctaaccacatctcacagtcataactcagaggagaaatgaggaagaattgttctacccatgtgcacatatggctgccagacaatctcatggcacatgttggcttcaacagaaaggccatggcaggggccagagaagggacataaggggagacactagttataccttcatgaagtccaccagaccctgcagagttgatgactgcaagggcatttgggaaaggtcaagaggatttgagctgatatgttagaggtctcttattcagaatgagaatgtgtgttttctagttcttgctaagaaaatttcagcttaacaaaacatgaagatacatctaaataaaattaagggctggtaaacctgacagtcttaataatttgtattcagctttctccatgccatagctattgtttttctagatcactactgtgaacatcttggggatgccggtaacagttcagtataaaactcctttgtcagaggagttgaacctcatatacaaaatgctgtctttttatacccaagatagggccaaaactctttagctagcctgatgatacccagggaaagagccattggtatacacctgaggtccctgtttagggtccaagtgaaaagagactataacagcaaggccaggagacccatgagtgcttgtggtgtcagagtcagatcttagatgctgttgtggcttcactttctcattacccttccccattcctttccctcacaacttctttcttcttcccatcagaaaataggtaaatgaaaacaaaccagccttataaaataccataaaagtatccatacctgtggcttatgtttttcccatgcactaataggattttatatactcacctatgaattaagaggattgaagtagatagccaccagaatcccttctagttacagaattttgtgatctatttgagatcaagtctaatgtgctttcagtataaataaggattcagagagatttgtggaaattgaagtctgcatggcctaaaggaactgaacctttagggtacatgcagtactttgataattctgaagtcccaggtgaaatgtgattcctggaagtttttcatatcaggatactcagagtgcagtcttacacaggttatgcagagcagattttttatcacactgtaggaaactatgctgtcttagtccattttgtgctgctataacaaaatgccacagactgggtaatttataaagaaaaatttatttctcacagttcgggaggctggaaagtccaagatccagaggctgcagctggcaaggcccttcttgctgtgtcatcccatggtggagggtaggaggcaggagagagatcccactcccaaaaaagctatttgattagggtattacacccacacatgagagtggagccctcatgcctactcacctctcaaaggtcccacctctcaataccgttacaatggcaattgaatttcagcttgagttttggggggaaaaacattcaacccgtagcagatgccaagcccgctgcccctccgtctttgcttccttctgctactggcagtttcacatcaagcaatagtgaaaaaagctcacaaaacaaggtgcatttatcctgctttcaaaatgatttgattctccctagtgcagagggtttttatcgttatttttaacaactctgtggatacataaactgtttgagttgtgtacttttctcaccagtgaaatttgcaaaaaccagttttttgaaaaaacaaactttccattgtgtgcctttcattatagcgacagaaactcatgatcaccactgacttccctcacctgcttcctcctcacttccacagtcatttgttaacatacacatgggtacaccagcacctgcacacatggcacacacacactaactctgccacactcacacattgccctttcatctccatcatttccctgtggtattggggatttgtgaggttttcagcaagatgaccataaagtgcctaaggatgagcaaagagcctgccaattgccataaaaaatatggctcccagaaaagcaatgaatcgaagccagcagcagatcctggatctgcctcccttgtcaaggaaaactgtcaggtctcagggtcacactccttaaccttcctcctttgtggcccaaagtctgttttgtagctcagaataaaaaagagaatcttatttggtgtcctcgtgtattgtaaaaccccctcaggaagcagagcaagaagctgaggactgtaaattaagactggattgtgctttttattccattaggcttcttaacacaactatgaataaatcactgggcctctctgcaggttgggctcccatcatgtaaactggaggtgaatcacacccttctggagtcctcagcattccaagtggctcccaggcctcgtaagcccggcatcttatcgtgattcgttgggtgagggaaaagcatgccgagagaggactggggttcttccagaggagcctcgtggtccttacaaagcaggaatttctttttttttttttttccatagagtgtttccctgtcaaaatgccaaaattttatggtgctagactgcagaactgctagattttttgtaaagcttaaaataatgcaaatgttaacactcttaaaagttagatctatttttaaaattatgccaaagatattaatacactgcattcaaaaaatcttaatgattacagaaaagtattcagcattgaggtctacctacaaaattgtttggtattgattattagcagctgataataattctatatgttttgccacctaatttgtggagaaagatataggtatagatacagatataaatataaaaacatagagacaaatacagtcttcagtaaagtatattcttactcagcagggaaggaaatatcttccggtgttccctggtcagctttttttttttataaaacaaagccaagtttcaaagtaattttgtagtcaccatagaaatgctagaagttgaaaacatcagcagccattacactacttagagggactgccaaaagacttctctgcaagggataggatcctctgcgttctattcctgtggaaggtggcaaagacggaacaggatcctgcgagcctgtcttatttcctatctgataaaatcacttctaggtaagaaaagtgggttggattttcttacctatgcatgattcatttccttccctgacttttcgtgatatatcccttgttaaatcagtcaacagatgtctgttttaagagtgattttttttcttatggtatttcatgaagaatttgaatagcagcaaaatttttagtatatttactaatttagtaatttgacataccatagcaagatagaagtcatttctcagtgtgtactaagtcaacagttccttatctgggacctaatgaaaaattatccatttactaaagataggacttcacaaagtaactaaaatatcacatttgtcacccttgtatttgaatcacataaattcacaagctccagctggcaattaaattatctcatcaattacaaagtaatcaagagagaactgttacttaacaaatataggctgcttttatagacaaaccctttcaaaccagggagaggaaatagggggcagtaaaaaaaaatacctggaaaaagacactgtgtgatgaaaaaaaatcaaaacttattgcagtagatgatgattagcaaagtactagggatgccccattgtgggttatttagctttccataaagtagtgtgagtataattgtttctttataagtatttgctgaataaagagttttcataaaagctcatctttcctaaaagtgccacagtatttttatttgcagatttaaagtgagtttaggatatttttgctttgagaatattttaattttttttaaatgcttaagtaacacatggttattataacaaattcaggtgatgcagaactatataaagcaaaaactagaagtccttcttggagttgtacttcccagaggttaccactgttgacaaattggtgtatgtccttccagctatttttttatgcaacatgtgtgttagtgttatttgaaagagttatacaaaaatggggtcataaagatagattgttctgaaatttgcttctttccctcacttaattctaatagtatgtgatgaacagctttccatattagtaaatgttactgtaactcattattttaatgcattcatttgtatagctctatcacagttatttaattattctaataacaatttcccaaattttctattataaacaatgtggaaacacacacttttatgcatatttttgtacctttctggtcacactagtattcctaaagcataaattcttagtaagagaattgctgatagtatcagtttggccgtgaaccatagtcaaagatcttgtctttgtcgagccttttaagcctgaagaccttgtttgatttcctggccttaaaggtgtctgaagcagtggatgcacgtgggatgacaaggtccttaattgccctttttgccagcaccagtcttatttccttctaatgtttctaactgcttaagtcataacagaagcagttggcttttcaagtctagaagcatcgcaattgtgggactatccatcagcttagattgcaggcacaggctacccaccacctttagacctttgcctgagtcaatgtcgacgtcgatctctctctctctctgtcaggtacagtaagaggcagcttctcaaagcactgctgttagcttagtttccccaacatccccagtgagaattgggagggaaagtgaacaggaaagttaccctgtattcgcagcagagattttgcttagaatgccttctcttaaagtagccttccaaaaaattgacagaagccaactcacatatttgtaagaccccactgtccctcaagacacaaataaattagatttgtatgtctgtcagatagaggctgggtgcattggcttatgcctgtaattccagcattgtgtgaggccgagacgggtagatcacttgaggtcaggagttcaagaccagcctggacaacatggtgaaaccccgtttctactaaagatgtaaaaattagctgggcatgatggcaagcgcctgtaatcctagctattctggaggcagaggcaggagaattgcttgagcccaggaggtggggaggttgagctgagatcgtgccactgcactccagcctgggtgacagagcgagactccatctcaaaaaaaaaaaaaaaaaaaaggatttgtgtatctgtcagatggagataacaactgtttttgagtatgtattggcaagattgatttaagacgaaaccactccccctcattaaatggatatgtattatataatgaagtctccaaccatttgatttaattaattccttttgtaagacagcgttgcaagtaacttctgcaaatatagacagttgtcagaaataaactgctggttcaaaaattgtattgagcacttgagcctttatgaattatgttaaacagactcatcctttgccctcctgaagcttttgggcccagtgtaaacatctcagccaccaaggcaaaccttgacccatatcctaagttaataactaggcagcctcttagcatacctacaagagggagtcagtgccttgggtggaggacagcaaatggggaacagagtcatcgtggcccttttaccccatgacgacagtcctcaccgtgaattacataactttctaatatgagtgtaggaggagtaacaagtagcacattcacaatttaagccttattttctatttcaccgtttgtttacatagctaaagaattgtctttctatttaatacttaatgataaataaacataaatttggattttatatcagggaagctttattcagtattttacaatattaggtgtttttaaaactcaaagtacagattaacattagtttttccctgataatggagtaatataaacagttatatgaatacactgatgtaggcttattgtggagagtttttttaaactatatagtacatgcctgcatttatttatctcgaaatctagtatagccacatgttcatttaccaagatttttaaatgttaaatcccacttgagtgaacatcgcagcctagaaataatttaaataggtgattgtagagggtttgttagataattaagctgtagctactaagtagaatgttatgaaatcattaaaagctacaggcttctggtttctggtccaacatataaggagtttgaagtcttcaatctaacagcaagtaaaaaaattgaacaaaatgaaaaatcaattcttcttagatcagttagagaggtgaggtcatagggcaaactactgcccccagaattggagagacaggcaagcagaacaaagaatcacaacttactggagtaagaacctatgagcagtgacctctgcaggaaccgatactggggtaagaaaacctaaactgtaattaacatactgctggaggctcactacagagaagtctgagagttaaaaactgcaggagtacccagtcatgagaagtcgggggctctccacacttttgttagttttacttccaggagcttgactgggtcctcacgatggatgtcgaagaaaaatcttgccctgattctgacagagggaggaaaaaagtagccatttgaaacacacaaaagcattctgttcttttcagcaaggcctgccctcaggagaaactatattgtcagaacttaactgactttggtaagggaaatactcaactctagccccctctagtcttccatgtggaagaaggggagtacccaactccagcccatcctagatattctgttccacctaaggagggggaaagactgagaagcacttgtgaaactcgtagcccaggagcacaggcctactaaaagactgaaacctgttcatagagctatagaacacttgccttctttacccccatcttaccacaaaactaaaggctgtttgccagaatatctttcacctagtatattacgtctgggtttgaactaaaaattataaggcctactaacaggcaaaaaacagagtttaaagaggcaaaacaagcatcagaaccagactcacacatggcagggatgctggacttatcagaccaggaatttaaactaactgtggttagtatgccaagggctataagggaagaaggaggcaatatgccagaacagatggacatcataaggagagaggtggaaattctaagcaagaatcaaaaagaagtcctagagatcaaaaacactgtaacagacatgaaaaataactttgatggactcacgggcacactggacatgactaaagaaagaatatctgaactcttgaggatatgtcaatagaaactttcaaaactgcatagcaaagagaaaagagactggagaaaaaaaaaggaacagaacatccaagaactgtgggacaactacagaagatgtacaatgtgtttaataggaataccagaagaaagacaagggaacagaagaaatatttgaaggaataatgactgagactttctccaaattaatgtcaaacattaaaccacagagccagaaaactcataaaacaccaagcaaaataaatacacacacacacacagaacattacacctaagcatatccaaactgcagaaaattaaaaattaaaaaattttgaaagaagccagagggggaaaaaagcttccttacaggagaacaaagacaagtattatatgtgactcttcctgagaaatcatacaagcaagaagagagtgagatgcaataatttaaattgttaagaggaaaaagaaaccaacctagaattctgtacccaaacacaaaattattcttcaaaagtgaaggagaataaatattttttcagacaaacaaaaattaaggacatttgtgctcagtggacctgcctagcaagaaatgttaaaagttcttcagagaaaaggaaaatgatatgttagcaacatggatctatgtaaacaaaggaagagcattgaaaaaggaataaaccaaggtaaaataagaatttttcttattcttaatcacataaataattctaagtaatgatagcaacagtgtattcagttacatacacgtgtgtgtatgcttacgtataagtgaaatgagtggcagcaatgatgcaagggacaagagggaagaatgagggatattttgttattataaggtacttgtactactcatgatgtggtataatgttatttggaagtggatttggatagtataatacaaactccagagcaaccactagaaaaaataagagagaaatataaatgacatgctaagaaaggagagaaaattgacattatataaagtcctcaattaaagccacaaaaggcagtgaaagagtagaagacaaacataggaacaaacaacaagggcagcaaatagaaaacagtaacaaattggtagatattattccagctgtttcattaatcactgtaaacatcagtggtctgaatataccaattaaaaaacagtttgtcagagttgatcaaaaaagaaccagctgtattttgtatgtaggaagcccactttaaacataaaacacatatggactaaaagtagacaatgctaatactaatcaaacgaaagtgggagtagctatattaatttcagatggagcagacttcagagcaagaaaagttatccaggatttaaaaaaaaagtatgacataatgaataataaagagattaattatccaagaaggggtaacaattttttttttttggagatggagtctcgctctgtcacccaggctcccaggttcaagtgattctcttacctcaacctcctgagtagctgggattataggcgcacgccaccacacccagttaatttttgtatttttagtagagacggggttttgccatgttggccaggctggtctcgatctcctgacctctggtgatccgcctgccttggcctcccaaagtgctgggattacaggcatgagccactgtgcccgaccaggataacaattcttagacatctatgtgactaacagcaccaactatatatgaggcaaaaaaaaaaaaaaaactacaaggagaagtggatgaattcattattatcctctgacagaaataaacagacccagcaggcagaaaatcagcagacatagttgaactcaacggcactattacttaactggatataattgacatctatagagtacttcatttaatgacaacagatggcacactctgcttaagctcaattggaacattcaccaagatatagaccacagtccaggccataagatacatatttacactgtctgtttttaccacagtggaattaaactagaaatcagtaacaaacgtagctggaaaattccaaaatacttggagattaaactgcacacttctaaataacagatgggtcaaaggagaaatcttaagaaaaattaaaagatattttgaactaaatgaaaaacaacttaatcaaaatttgtaggattttggaggacagccactgagtctgtcacagtgcctggcctctaccaaacaattaaggaaaaaaactttatcaactctctgcaatctcttttggagaacagaagcaaagagaattcttcccaacttattctgtgaggccagcattatcctaatagcaaaaccaggcaaagacaaggaaactacagccctatatctcttgtgaacatagatgcagaaatctttaacaaaatattagcagatcatatccaactatatagaaaaagaattatataccatgaccaagggagatttatcccaggtgtgcaaggctgatttaacattcaaaatcaattattgtagtgaatcacatcaacacctgctcatgctaaaaataactcccagcaaactaggaataaaagggaccttaaagaacatgtagaaaactctacaactaacatcatacttaatgctgaaaaactagaagctttcctgctaagactaggaacggagtaaaactgtccctctcacatcttcttttctgtatcacactgtaaatcttagctaatgcaataagaaaagaaaaaaaggtatcccgcttgggaaggacgtcagcattgtctttgtttgtctttgtttgcacataagatggttgtccatgtaggcaacctgaaagatttgaccacaaacctaacaaacagaaacaactctgggaactaataagtgattataacaaggttgtaggatataaggttaatatacaaaagttaatcacttttctatataccagcaatgcactagtggaatttgaaattaaaaacaatgccgtttccattagtatccaaaaagtgaaatacttgtaaatcttaacaaaatatgtataaggtctatagaggaaaactgcataactctgatgaaagaaaatgtaaaaggaactaaataaatggaaaaatattctatgtttatgtataggaagactcagtattgtcaagatgttggtacttctcaaatcaatctatagatttaatgcagttccactcaaaatcccatcaagttattatgtaatagtcaaactgattctaaagtttatatggagaggcataagacccagaatagccaacacagtattgaagaagaataaagttggaggactgacgctacctgacttcaagacttactgtaaagctatggtaatcaaggcagtgtggtattggtgaaaaaatagacaaatcagaacagagagcctagaaatagattgacccacttaaatatacagtcatccttcaacatccttggtggggattggttccaggactccccatggacacagatgctcaagtcctttatataatatggtatagtatttgcatataacccacatcctcccatacactttaaatcatttccagataacttataacacctgttataatttaaatactatgtaaataattgttatgctatatttaatgacagtagtaatacagtataatgtagtaataataatgtcattaatggaataatgacaaggaaaaacaatgtcagtacagttgcaaccatccatttttttcccaaatattttctattcatggttggttgaatccatggatgtggatcccacagatacagagggctgactatattcaactgacctttgacagaggagcaaagaaaataaatcaaaaaaagatcatcttttcaacaaatgatgctggaagaactggacatttattcacatgcaaaaaaacatgaatctggatatagacccttctgcacccttcacaaaaattaactcaaaatgatcacagacctaaatgtagaatgtaaactataaaactcctagaagttaccctaggagaaaatctagatgaccttgggtatggcagtgacttttcatatacaacacaacatcagaggcatgatccatgaaagaaatacctgataagctggacttcgttataatttaaaacttctctgtgaaagacactgtcaagaaaaagaggaaacaagccacacgttgggagaaatatttgtaaaagttatgtctgataaaggactgttatctaagttacaaaaaactcttaaaactcaacaatacaaaacaaacacccagtttaaaaatcggcaaaagacctgaacagacacctaaccaaagcagatgacaaataaacacatgaaaagatatttaacatcgtatgtcaataagaaattgcagattaaagcaacaatgagatacctctacacacctgttagagcggccaagatgcaaaacacagacaacaccaaatcctgacaaggatgtggagcaacaggaactctcagccattgctgatagaaatgcaaaatcatacaggcactttagaagacagttgtagatttctgataaaattaagcagattcttacatacaattcagcagttgtgctccttggtatgagttgaaaatttacgtacacatgaaaacctttgcatgaatatttacagcagccttattcataatagccaaaacttgaaagcagtcaagatgtccttcagtaggtgaatggttaagtaaactggtatatccagacaatggaatactcttcagcactaaagagaaatgagctatctgtcaagccatgaaaagacatggaggaaacttaaatgcatacaccaagtgaaagatgccgttctaaacaggcagtgtactgcatcatccaactgtatggcattctgggaaaaagaaaactgcagagccagtgaagagatcagtggttagggggaagagagggaggaataggcagagcacaggggaattttaaagcagtgaaactcctctgtatgatattgtaatggtgggtacatgtcattatacttttgccaaaacccattgaatgtacaccaagagtgaagcttgatataaactgtggatttggggtgataatgaagtgtcaatataagttcactgattgtaacaaacgtacactctggtggaggatgctgatagtgggagagtttatacatgagtcggggcagggagtcaatgagaactctactttccaccccattttgctatgaacctaaaactgctctaataaatagactgtgtttttcagtgttatgtgacgaaggtttaacctgagaaaaaaacaatatattgttaatttttaataattattaaacaatttctgttctttgctgttgtttttctctgccactggtcttcacctgtttgtttgttttggtttttgaaacagggtcttgctctgtcacgaaggctgtagtgcagcggtgatcatagctcactgcagccttaaactcccaggctcaagtgatcctttcacctcagcctcctgagtagttgggaccacaggcacatgccaccacacctagctaatttttttttttttttttcatagagagagtgtctctctatgttgtccaggctggtctcaaactcctggccttgagcaatcttcccaccttggcctcccagcctggacttcatctgttttgttcacaactataaccctgcctcctagtacagagcctggcatattgtaaaaaaaaaaaaaaaaaaagcaacagtaatagcttcattctgaaatagtatattcagtgatgtgttgggtactgctctgagtactttacatatatatgtactcatttaaacttcacaactttgaaataagtacttattcccagtgtacaaatggagaaactaagacaccagaaggtcaagcaacttgcccagatttacatcgctagtaagtggtagaaatggaatttgaccccaggttgtatgacctgaatgtttgctcttcaccaacttataccacctttccttaaaagacagtccacaaatatttattgattgggtgaatgaatatgagtgaaataatgaaatgaaaagacaacttttaatatagtatcattagtacatttttattttaaaatgtgtccatgcacagtacccaaatgttcattattactaacagatgataaattgtagtaaagtcatacagtggaatactatatagcagtgaggaaagtgagttacaactacatataacagcgtgtatgattctcgtgagcataatgttgagcaaaagaagccacaccctaaagagtctctgtttactgttccatctataccaaggacaaaagaggcacattagaagtcagaatgctgggaaccctcggggcagagcgggaagggcaggagtgttctccccttcctccggtgctggttacatgggtgtgttcaatttgtaaaagttttttgagctatacacgtatgtgtgcaggtttttttttttttttttttgagacggagtctcactctgtcgcccaggctggtgttcagtggcgcgatctcggctcactgcaagctccacctcccaggttcaagccattctgcctcagcttcctgagtagctgggactacaggtgcccaccaccacacccggctaatttttttatatttttagtagagacggggtttcaccgtgttagccaggatggtctcgatctcctgacctcgtgatccgcctgcctcggcctcccaaagtgctgggattacaggagtgagccaccgcacccggcatgtgcaggttttttgattggtaaattctacgttaaataaacagctttttaaatgactaagttagataaaaagggtcaaaaagataaataagatgttgaaagtgtatttgcccaaaacattctttaactgtagatattttttggaaacagtgctatgagtaattttccgtttcatttttgagagttcttaggttttcagatgtagtaaaattgtcacatattgcctgtgtaattagatttctaaaatgtgattaaaatgaacttaccccaaaatcaacatatgcacagcatgagttggtcatgtgggtgttggctcctgatgggtgataaaaaggacaccagcccactggctgccttgcttgccctcctgactttagtccacaatctttgaagcttcataggatgtctccagggatttctaatcagtgttttgtgtgtttcttacatttttattcccttttccaggctgaacagtccaaagaagagcagaagcaaggtctgaatgcagagaagttgatgaggcaagtctccaaggacgtgtgtcggctccgggagcagagccagaaggtgcctcggcaggtgcagtccttcaggtgaatagccccatccaggacagcttttgggttgccctcacggggtctgattgtgtaggaattcacctcagtgcagtgaaagttaatatgaggatccgagacagaagtcctctgttctctaccttgaatatataattttccatttgcacctgaggtgataaatgtgactggcagagttaaaggctgatgaaagcctaactccccacaagaacccagggtgtccccagctcttagtagctgttagcacatctcactgggctatcttgacacaggatacaaaggtacagaaaactcagacatctttgggattttgttcgctcattttacagacattccttgggcagccccagaaaccttacaccttgtcaggctctgagatgtggaggctaagaacatgtgcattcgttctgctcttctggggggctctaggctgtggcagggataggcgggtaaccaggtcattgcagtgcatgtggaaggagctaactaaagggataggtagggacctgtgagagatgtgggaggagcctcagtcagtatggggcaggtgctggggctgcgggcaccagcagaggagattataagagaacccatcatggaaggatggctgcaagctccttaggcacctaggggtggcagttttgagtgggacattgaggcgggaagaacagcatggacagaggcacagaccttagaagtcagtgccaagctctggcgcatggggagttgccagctggtgagcctgcccaggagaactgggctcaagttgcacaggccttggaagctgtgcagaaggcttccacccgtggtctctgacgggcggccagcagggctctccgtgcacaaaaccaaatgatggggatgggttttatgtagggcagatatcagaggcattgtggagagtgggctggggagaagcgggtaagggtggccagttaggttcatgggaggtttgtggggggcagtggctgccctgtggtgccagcgctcgagatggagaatgctggggagcaggggtgtggggaggatgctgacctctgccatggcacaccaggcaatgccagcaggctagtgagataaccatgaccagtagacaagtggaaataaaaatctaaagccagggttaggggtcaggatggagattaaaaaatgggagtgctcatcttcaatgcattggtctcatctgtggaaatgggccagacatcccagaaaatgtgaggtgactgggaaaggaggctggtgggcaccaatcactgaagggctcgccccaaaagagatgctagaaagaatggctggagaggtcagaggagaaccaggagcctggggcaagagggtgggaagaggagattgatggagagaactgaaaagtacatccgggatccctggtgagcacactagatggtttcagccccgacggagggagctcagcaaaaaggtttgttcctattgcgtttttatttggttttggttgaggttttgtatagacgagtctttggaaagtgtttaggcataaaggggagaagcccagaagaagcgagtgtttttgaagtgtggggaagctaggtcacgtggtggagcagggacagctatggcaggctgaggtctggtaccaagcgggagggcagggccacggaccgtgtggcagcagcagtgtgccttagtgggctcacagctctttcatttttctgcaacaccctgcagtagagaggtttttccaccctcttttctgctaaagaatcacatttgtgactttcagggactaccactacttgggttttagaactgcaggtgaggggagcccatccatgtccctggtgctgtggtcacttagagaataagcagcattgtctagcgtggaaagtcacacaactcgcagttgttgccgaaacctgaagcaaagaatccacgaacattcccagcttcccttaagatacgaagcatattatatcaccagggaagtgacgagaatgatgagatggaccagggtgagacagaacatgctggaagcgtgggatttgcacggctaccgttgcctggcctggggtggtgagatcaggcagcggtggggcctgggccgttctgcccggcaccaccccagctgcttgtttcacctggaatcaggagcccgatggtccctggccttctaatttttcaagagaagttagaaatcaacagttttctgtgaaatatctcaaatgcaggtgccggcaactacttcaggtatttttaaacaccccagttagcagctgcgccttaaggcctccgctgacatcacacctacactcgtggcattttttgttcttgttttcctcttatgaattgaacaaatttaaaggacactgttcacagcagtagctcgttccagtgtccatagtgttctcactcctccttttcttctctatcctttcttagtcttcagaacatccccacctcagctctggtttctaacccgcacctcctcccccatctggactgttctttcgcaagggagaaccagtgcttgattcttcagctaccagcatgccccttgcatgtaatatgccctcaagaaatacgtgctgacggcataaatgccatgtacagtgtgaagttctgtagggaaatagacgcactgtttgtcttttttttaagcactctcctcacctgaaaaccgctctgccctgtctcagcctctccgctgcttcgggaccagggcagttactaccttgcagatagttcctccttctcctttcatttgcgtcgtggtgtcgctcatcaggttgtccctgccccggcatggtatcgatgtaaagacttttcctgttattgtgtgcttttctgtgaggttactgagaagtttccaggtaggattttgggccttttgagtcttctgctacctagttcggaaacacccatcctagaccaaacccctactagtttaaaaactgtcttctgttggaagttccctgaagggaacttacgggcttggtctgtaggtgacttccgtgatccagagctgctgttctccttgataccccccctttaagcaggcagaggctctcctgattttaaatggagttctgcgtaaggaaaagagcttctacctgtgcttgcagagacatcactgccactgcaggtcttggggactgttttaatggtcccagagtatttttagcatcatatataagtcaatttatttctcaccccaactctagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaataagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaaagtccagcaaaccagcccagaaacagggcctccccaaactcccacctggggacaaagtctgggacgttctcatcccagaactcctgaaccgtcttgtgggcaacccaagagacgggaaccagggctgtgactcccgaggcccaggacagaattcctcccaggatcagcagtcgcctcttgagatctctctgactctctccaattctcaaacagtccaggccaaacccagagaccagcaggcccagaaatcccagcccatttgacagaaacattaagatcctggagaccctgagttcagcaggcaaagccaggaaggagtcaaagtccttgcattgcatccccacttcctcttggatgacacaggtttgccagagtcccatggtccagttttccatttcatttaagtccaggttgaggttcttccagtgtggcaggtagtttgtaagacaggataaaacccatcccagcaaagataatgaaactccagctagttgagctacagttctaaatactaaagccattataatgtcctgagagctttagccaaactaactcctgcccttcggttgctgtgaaaagaagtgtgacacttgtgttataacttatgaaactcagaaatatttcttcattgtgtatataggaggattcttgccagagttgctattgtttgattccatgttgaatgggtttcacaaaaggatagggaaataatgccgccaaccagtaatgccaaggtgtggccaagattgtgtttgtgtcctgtgggctggatttgacagaaagcagtttgtcactgaaatataattaagtgataatctcctttcattgtcaaggttaaaatggctttcatgttattcccaacctttctaacaaagaattaagtctaaatgcaaaatgtttaactgatggttttggttcaactcctcctgctttgtgtttcactaactgcacctgtcagattttcatctcttatagttctcacatttcaaatgtgcatgttatggtaatactgagtgttattttttaaaaataggtttaagaaaagtatttcttaaccaaataaatcaatcttatcagaaatctctctacaccttaactcactcctgcgtttcagaaattcctcaggctacatataccacatggcatatgaagcaatactgaactacagatctagtttatttatctgcatgcctttctgtcaaattcacgcttgtgtgcataaacacttttttttcttatatatgctttctgtgccgaggaaagttcagcatttggactctgcaggttggagtcagcatttctgtttattcaccactaaagtagatatccccatgttagcgatttttcattgaacaaaggaaaggttttattcaaatgacctgacaatatcaggatatcaagaaaaatgtctttggaattgtttttctttttttaatacgaaggttttgagggaaaggatgagagaagagattggccaccattttaaatctgagaggatcacaaggtactgaaaactcttcagcctcataaaatcttgccgcactgagtgcctggtaatatcctaaaaacaaaccacttctgttcaaagaagaaaaaggtcattgttgtggaaataacactttgaggttggcttagcatgtggttttgctaaagtagaacacttaaaattttcagattgttagtttttttctttaggaaacagaaactaaagatcatttctgactaccaacagcaacaacaaaaaaaagaaaaacagaaaaaagctttctaatatgaaatttacacattaaagcttgaaactgactgtattggacagccaccacattaatttcaataaccagatcaatgaagcttgtttcacttctacctgtataatgcttaccataatcattttcttttagataaaagatttttccttcattattcagattttagagggaagtgggtctacctactgtagaaaaatagtgaatgagaaaacgtgagcatcacaggtttagctacaaaacaaagaggtctttgtcatcacagttgatacaggatacatctctggccttgtcggagtcttacacttgaggatctgctgtcccatcttccaggtagggacactgagtttgcatttgcgccactgcatagtggcccaaagctaggggagcgtggctggagcaggctgcgcagttgagcagacaccctcctagcagaagagaaagtccagcaaaccagcccagaaacagggcctccccaaactcccacctggggacaaagtctgggacgttctcatcccagaactcctgaaccgtcttgtgggcaacccaagagacgggaaccagggctgtgattcccgaggcccaggacagaattcctcccagaatgagcagtcgcctcttgagatctctctgactctctccaattctcaaacagtccaggccaaacccagagaccagcaggcccagaaatcccagcccatttgacagaaacattaagatcctggagaccctgagttcagcaggcaaagccaggaaggagtcaaagtccttgcattgcatccccacttcctcttggatgacacaggtttgccagagtcccatggtccagttttccatttcatttaagtccaggttgaggttcttccagtgtggcaaataagttgtaataatggataaaatccatcccaggagagatagtaaaagtccaacagattgcattgctgttctaaagattaaagccattgcgacaggtcttaggactttgccacccctataggatctgctgtcctttgtggttgacggtaatgtgacaatcttggttctatgctgcctggaatataagctgtggtcattaactctttgggcactctgaaatgcgtttttgttcttcttgaatataatgtttcacgtaaaggacgaaggactctgttaaaactatgagttgggctttctgataaggacttgatctgttaccttccaatttggtaaaattatatccccaatgcttgatgattataagtctaaggatgaacaaagagggctctatgacccctcaccctaaaatacaacagaaatctttgtgcttcagtatggattaattagattttaagtggtgataaaaggccagctctttctacaacaggacttcattgtaagagctgaatctgaaatttcagggatgcaaaacaaggtcttgtaaagaaaggtagactgtttcctataatctctattcttctcagacttccttaacctacacaagagcctggcccacatcctcgagtgtcgcaggagctcagagttggcaggaaggttcctcggattcctttgaaaggtagaggctggcttacgggactgattaaaatgaaaaggactgaggctgatgctgggggctactgagtgcggaagggaacgtcccgggcagttccagcattcactctgtggttttctccatcctcgttaaggacttgggggtaaagcatgatatcttagcgtccagggaggtgttttttgtccagagctgagctgtccccttgtcatttcagcagcttacgcagagcaacaccaggcttcaagactcctgccagctcccagacaaaagtctctggtacaaacacaatagccacaatggagctgaacttcgaggcttcatcttgtttatttttttggttgaggccacaccttgagagcatacttacgcagagggttgacccctcagagaacacaggaccggcctcacaggccaggacaagaggtcacctgccccagattcccagggctgcaccgtctcctctccacatggcccctgggcatcctgcacctgctcagaggagataaaatcagatgggcccacaggacagaaaagtccctaaaggtggagccactcccctgagaggttctaacctggagaagtagaaccactgcccatcacgttgcaacagtggagtgtagcccaggatcagaaattatcttctattgtgtctctaaataggagatcggagagacagaacatggatcccgatgtatccaaattactttggataagattgcataagatgtagatttgaggtggtactttcttcagcttttcctatcatcttaagtttaaaaagaaaaaactatgcaccagatgaactcttccttaatttttacaaattttcagaattcctgaggatgtattggtgcccccaccatcctgaaataagtcattccagggtgcttaaaggtacctggatccagagggccggagacctgtctggggcctcatcaccagtgcacaggatatggcaagcttgagctctcttccaggaggcagtcggggtggtgaaggcctggagagcaagtgggaaagatcatagggagatgattcttaatatcacagtgaaacgctttttaaaaacctaatggaataggctgctccgtgacgtagtgagctctccctgctgcaggcatctaagccaaaggttatcacctgccaaggttatcacggaggggatttctgctgtggtgggtgttggacctgcataacctctgagcaccttcccaattcatttattctgtcagcattaaaaaaatatgttgtgggctgggcgcggtggctcatgcctgtaaccccaagacttttggaggtcgaggcaggcggatcacaaggtcaggagtttgagaccagcctgaccaacatggtgaaaccccgtttctactaaaaatacaaaaattagccaggcatggtggcgggcgcctgtaatcccagctactcaggaggctgaggcaggagaatcgcctgaaccggggaggcagaggttgcagtgagccaagatgcgccactgcactccagcctgggcgacagaacgagactctgtctgaaaaaaaaaaaaaaaaaagttgtgagcccctcctgctgagcaggcactgggtgctgaacaggagtccctgaacccctgacctcaggtgatccggctgcctcggcctcccaaagtgctgggattataggcatgagccaccgtacccagctggcaatttctatgtattttgctcatgaatgtgcagcctgggactcagcagggaccacttgtctctgctccaggcagcgtcagctcaactgggggctggagggtccctttccaagatgggtcacccacatggcgggctgccagcagggagctcagcctctttcgtcatatagggtacaaaaaccacacagacaaggccacctcaagccaaatggtagccagattgctgctgtaagcagcccccacctcatcagctggcaacaggagccatggaccctgggtcctgcaagacagggttgaggaaggacgaaagcagaggccagagaggtccagtaaaagctttggattctgaagtcagtggagaagccaaatcctccattgtcaaaattaccctttaaaaatcccttaagcattggagatcaatacacatctctccccaggcccagctcgctggggtcttctctggcaatgagcaaggttactctgggtccacaggttgagcacaaaatgaagaaggaggcttagtttgggatcttgcaggaagattatctgctgaatctgaaggcagcagaatccagagaggaggccaggaagagccgcccttcctcctagcaggcgcgggcctccctggcactttgataaataggtgaagatgaggggttcctcttgctaaacatagttttatctgattaaaagaaaatctatagtttattttttcttgatttttctttcttttttttttttttcttggagacagagttttgctcttgttgcccaggctggagtgcagatctcagctcactgccacctccgtctgctgggttcaagtgattcttgtgtctcagcctcccattttgttaatatttctaatccttctaaatagtaattcacactattaatgctattaagcttgttattaaggagaagacacgctgttaccctcacaacccccacagcacaataccttgtatctactatgtgttcagcaaatatttgtctattaaattgattagaaggatccttctaaatgataatgaaagtaaatatagaatgccaacactatagatgccattcccattgccagtgccctttcatcgtggtgacaaaaccagctgtcctggagcgtctgaacatgaataatgaacttaaatagaagaaatgaactcaccatccacctagagtgggagaggaaatattgctgaagcctcacgagttagcaaacaagagcatccccttccagacgggcatcaagaatgacatctcttaggtgcgggaaaaagactagaaggctgaaggccccccaaaatattcacagggtgctagaaatggatgctttttcttttccttgttttgatttttattttctaaattttctacaaagactgtgcaggacgatcataagaaaaagaatgatataaaagaaaaaaagatgatctgctggacaaaattaactttcttttgtcagatcataataataggtaatagttatcaagagccttctacataccgggcactgttctgagactttaacatggattatctcattgaaccctcacaatcacacaatgggggtagatactaggtacatcactattttacagacgatagggctaagcacaatgggcaagtaacttgcccgaggtcatggggtcatttacagagccatggaggcagcacctcagttcctttcccagtgatatggtttggctgtgtccccacccggatctcatcttgaattcccacgtgttgagggaggggcctggtgggaggtaattgaatcatgggggcaggtctttcccgtgctgttctcatggtcgtgaataaatcttacgagatcttatggttctataagggggagtttccctgcacaagctctcactctctttgcctgctgccatccatgtaagatgtgacttgcttcaccttgccttctgccatggttgtgaggcttccccagccacgtggagctgtaagtccattaaacctctttcttttgtaaattgctcagtctcaggtatgtctttatcagcagtgtgaaaatggactaatacactcagagcacagaagtacctggggctagacctctgagactattctgcacagtgttgttccaagcagagcttctgcactgaaaccacctgaggagcttatccagctcaacgttcgggttccccacccccatgcctgcagtgtgctggtaaatgttcaacagcaactctcaggttggtagccctggattacaacctctgccaatttccatggtgtaaatactctcaccatggccaattccaggctaccaatgtggaatcactgagtatgcagtgagttaggaagagataatacagtcatataatggtgactatttatggcaatgaggacacatgctgagaaatgagtcattaggcaatttttgtcattgtgcaaacatcacagagtgggcttacacaaacctagatgctctagcctcctccaccccgaggctgtatggtatggcctattgctcctaggctgcaaacctatacagcaggttactatactgaggactgcaggcagtcttaacacaataaggatttgcgtatctaaacatagaaaagatgcagtgaaggccaggtgcggtggctcacacctgtaatcccagcactttgggaggctgaggtgggcggatcacctgaggtcaggagttcaagatcagcctggccaacatggtgagaccccatctctactaaaaatacaaaaattttagccaggtgtggtggcacatgcctgtaatctcagctactcggaaggctgaggcaggagaatcacttgaacctgggaggcagaggttgcaatgagctgagattgcaccactacactccagcctgggcaacagagtgagactgtgtctcaaaaaaaaaaaaaaaaaaaagaaaagaaaagaaaagaaaaaagatgcagtggaagtgcagtattataatcttaatgcactgccatatacacagtctgtcgttgactgaaacgtcaatatattacatgaggctatctagatacaatagctatagataacctcaagaacatagataatagtaaaataatgaggaagggatatgtttggagtgttcatttgcttgtcatatcataagtttatataattcaattttcagtgatggctgtgtttaccaactcactcccagaattcctgaaaaattgacagctctctggagccggtgtgagacaggtcctgcacatccccatgacaagcacagacattgcacatcccggggagggtcccgggagctgggggcaggactctgcaggtcagcaagctcctccagctcttctcgcacacactgaggcttgtgagtttgagaactgggctatcaggctttactacccggagcacaggtctaagacccctcagaatcctcagccaagcccagccacactgcggatgctcagcctttaggccatggaggaggcagaagggcaggctggtctggattttaccaacccccctcctgtggtgcctacctcttgatttttgctatttcgctcaagtgacttgtctgcaatatagagtggtcccttatgtctttctgttccagtcctccaaacaccaccagcttggcctacaaacatttaggatgttggtgattaaaaatatatactgcttttggatttatagcacttactggttacttgaattgatcatttaattttatcattaccagccaatctattagttgaatgctcctgaagctttcatcaaagggtttggggaaagaaaagagaaaaaaaaaagtccaagttcttgcccattggaggaaaaaaagaaagccaaccagagactctaaggaaaaaatatataaacaagtataaactcatacttatctgaaaactgggactttaaacttgcaggcagtggcttcctacatcagaggatctttagggaaccaccagcagaaagttcctccctgtggcctgacacgttttgcccaggacattcagggggtgaatggaatgatagcaggtggtgggaggggttcagcccagcaggacatcaccaggacagatccagaggggtgtgtgcagacccctccagaaggcctcattgctgctgccctgcagctcccagtccagagggtgggggtctgaagacataagcaggatgtcacctccacgtaattactctgctgtgagtgactccaggggtgccctcagtccgattcgggtggtggcatttaagagaggaagtaggggaaccctagtcaatattcccttgatctctgcttgtgtgtacactggcaaggaggaatgtgtggatttccagcagcaggaaacaaaccgttttcatagctgagtgtgtgggggtggagtgtttctaaagcctagttatctcatgtgtctgtcttctgaggccctaactgagattttatggcaaactttcaaggtactaatgcctaagaagtaacaggagacaaggagacatcggctctcagtagtgaagggaacatcctgtcatgcaacaaccaagggacataggccagaataacgcgtctcagtctgttctgtgctactgtaacggaatacttaagactaggtaatttatcggaaatgtatttggcttgatccttctgtagttcgtgagcatgatgattgggtgctcacacacatatgtgagatgtaccaccctcaaaccttgttacaatgtcagcacattacccatctgacctgaaaaaaaaagaaagaaaaagaaacatatttggctcacagttctggaggctgggaagtccaagaccatggcactggcatctggtgagggcctctgtgctgtgtcgtgccatggctcaaggcagaagggcaagagaggatgagggtgagcgggcaagagggacccaaactcgcttttataaccacccactctcaagataactcactcccaagacaaaagcattaagtcctccctgagtacagagcccttttgacctaatcacctcttataaggccccacctctaaacacttgcaccgaagattatgtttccaacatatgaactttaggggacacattcaaaccgtagcaaaagcataataataatagccagtatttattaagcacttactgcttgctgggcgttaggttaagagctttagctgtgttactgtattctcacaagaactgtctgatgtagacaccatttttatcttcatttaacagataaggaatctgaggcttaagtaagccaattagttggccaaacaatggttcaaggattgaagcctgtctcacaccaaagtctagcccttaatcttttatgctgtatagagtgatctgacaccattgtcatggttgcctctccattttgtcctgaggctttgcttgcaaaagtcggcactcacttggcaagcactgtgcctcctcctcgggccagagtcagaaccctgaatgcatcctccggcagtcggggctgaagctgtgggaagcacatgctggctttgtggctgtaaagttagaaactgctacagcagaggggcttgacagggaaggttatgggaaatgtcctagccagggactccatctccacccactacgcaaatagaaatgaaaagacttctattttgggattaactgggttcttttatttgtaaatcctttctaaatattaatctaagctcccaaccctcatggctaatgtttcctttaagtttccagttaacacatgggaaaatcattgcaaatccgtgacagccttggcacctactcttgaagaggtgggtgtctgagactcatggaaccctagaggcagccaacacctcaggcatcacagtgccttcattttctagtgagctgacgatcagtgtcgagactctgacccggcctccagactcagattccagggcttcttcccctctgctgcgctgctggaatccacagccccagctggtgccccagccatcagaatatctgcccttttctccaggagagagactgaactccatgcaaacattagccaaacacaagccatgtcctggaaggcatgctgagagctggcagagaggggaaggtgagagatggaagcgcctggccctgggtagatatagcaggagcacaggcagggccatggatgtacccaatctggggaccatcgcagggagccctggacttcatgaacaggaggactctggtcctgcttcctaggacgaccttaaagaaacatcagcctgaagactttgggaccatcccaggcccagccaggagttgagacatgaggactttctgggcacaaaagttaaaaattgaacttgcaccatcgcctgagtcagctttgctgtgtgcccttctatctggagcacttatgttgcacaactccagggagcagcatttccatagaacacagtgtcaatcccatcactttcattctttctctttaaccagaaagaccaactgtagaaaaggtaaggtgttggccactcattcaacaagcctttgttgggcatctagtgccagcctcagggccaggccctggttatacagttaacaaagtagtcatggtccctgctttcatggagcttgaagtgtaacagagtttggcagaaaatacgtatacaatgcctaaatgaaaccaactatgggaaagacatcaattgaatacccacaagcatccatgccctgggcttccgggacctgcggcccccagcctggcagagtcactaccctcagacactcaccagggagaagtgggaaatccctcctgagccggggaagggaaaactctgcttcagtcagacctgccccctgaacctcaaggagctcaggtcacaggcttacagacctttccagaacagtgagccttcctgggaacccatctaaacagctgaccatgtcccagagactttagtgccgcctggaactctggaggatgtgacgttccaacttgaagcagctcaggatgtccagtaccagcatgtctaagtctggggtgtgggaggggccgtggaggggaggcctgccgtgggtctcctgttgacatgcacctgcggccgccaggctcccgtgtgccacaaacacaagcgctctttgctctctcaacaggttgttccattcaggttttttgaaaacagtgcgctaaccgggtctgaaggaggtctctctctcaaattcccctgcaaaggaaatcatgggattgcagtgagactttgtgtcatggccttctctttcataaaatccttgttgtctgtaatactcctgtttccagctcagaggctgctcccaaaatcaacagacttcccacccaactgcagagcccgcaggtcaaactcccccaaagaggatactattttacccagttgaggtaaaagagcctttgaaagtccccacctaatactcataaaaatggtcttatttcagagttattacacggatttctccctcaagaggatgaaacttttccataaattaaagattaatttaatgcaaatggaagacttggctctgagattagaaagacctgggttcaaattctgactctgctacttaaatctatgtggcctccctcgggtgacttaacttctctgagcctgtcacctagtctgtaaaatagtgatagtaactgtgccagcattcacgtggtgagactggggatagcataggaaagtctcacaacacatagtaagctctcaataaatgagagtccctatttttattttggatttggtttttcaaacccattttcagaggcagctgtgaaagtgcatttcatctgcgagtgggtggtttgttgtggtacactggctgaaacagatgcccttttcctgtctttatgcaactggatgcttctaaaattcttttttgtgccatggaaaaggcttgcctgcccatggatcgctcttcctcctcctccgacatgagcgagtgcttcgtgcttctctctctaggctgctccctcccacactgtaccgtccatggcgtttgtgctgagttctcactttccttcagactgagaggatcagataccctggtcagtgaccgtggttccggtccacctgctcgacctggggctgcggcagggaggctggattcagaggcagtgtttcttgccaagtttccctcaaatcctgctatgggagaagagctgtgggtattatcagcacaaagattcccaccaaccttcgctggaagaaaaatataatttctaagaggagaaacactgaataaagagattgtatatgtgaaatactttgcacctgtatctgaatcttttcatccatccatcatccatccatccatccacctattcatctatccatctgtcctcccatccatccatctgctcatccatccgtccgtccatccatccatccatccatctgctcatctgtccacccatccatccatccgtccatccatccatctgtccatccatctattcttcctgcattacgtatccttgtgttgaattcctgtaataagcacatcacacacaggggatcagggatggagaagaggggtcctctctgtcaagtaactcacagaacgttcaagaaggcagacgaggaaagaggcaactgcaataccgtgtgacaagcgtgaggtgagggaggagggagtgggagaagatactgagcacttggctaggacacgtagcctgtgcggcaccaccagggaggcttcccaaagttggtaatttttcatgtccatgcaaagcatgatgggagccatcagaatttaatgccacgcagagaggagggaacggacaacacaggggtaaggaacagcatgtgcgaggcccagaggccacagcagattcccaggctgggggccagtggcagccacaaggcaagggctgggctcagggcttctctttcttttttgggccatcaaccccttgtgcaactctgtgaggtttatgagtctcttttcagagtcatgtttttaaatgcataaattaaatacacaggatgacaaaggcaaccaatgacattgaaatacagtaatcacaacattaaaaaaatagtaatagatgtcatctattaacacattaaataacaagatctagcaaaggggctccaagtaccatggtgtctcagtggtgaaatgtgtaaatatttcaaggtattgtcaacaactgccatgtaatatgaaaatatctgtagtttccactggtgtcaaaataccggtgctcctagaccacatggtttattgcccacattcctaattaaagaaaatgctaaatttcagtttgaagttagtagaaaatgtaattcctcctccccaccatttcctattcccaagaagtcctttcttcgcattcacggactccagcctcacaaacccctggtcctaactcagtcagctcctcctgccacagctcctcagtcactctggattccatgacctcaacaatcccaaatgcgatcattgacacatttgtgtcactgtccttctcgcctgtgggcaggaattgcgtctgtcctttcacttctgtgaatccagagcccatcagagcaagtctgcacacattagatactcaggaaatgttaaatgaatgaatgagtcatgtcacaccaaggattgtggactttggacagggatttgggggtagagattggagtggcatgatgagatttactatgaatttcagagcgtgacaaaatcaaatctctgaggtgtcccgtttctaccgcatctattgtggctcaggtgaggcaactgcaagacaaacaggaaaagataaataaatctttataataaggaaaagataaatagattttatttcacttgtgggattcatgcaactcctacctgaatctttaataacaatggaaaaaaccatgatcctgtggcaaagaaaagaaaaaacaccttcttggccaattttaagacctgctgtggaaaaacaaaagtgctttaagaaataaacatagaagtaaatctttaacaaccagagagttaatttaatgccatgcagatattacaaaatatgagatacagctttaatgtgtcattagttttgaaactcaaaaaaaacaaacaagaatggactttgaatgataagaatatgtgttagtgtttctcgaacttgaagaatttacagagaaatagtttttaggctttcataatatgctcatgaaccccagtttgagaaaacactgacttaagaaacttaaagtctttttatgaaaatattaaatataaattaccattgtaagttttctcattatattcttagaattgctaatttaaaaaaaactaaaataaaaatataaaattaaaatcttgcagctatccaggcatctatgattcccagaatgaagaactttgtattttagaaaattataattacagtaaatagaatatctagttgcctgagaaataggtagttgccattttctttgatgttgtgatatactgacaaaacttatattttaattgtaagtggctgcaacttaagggaaaaagaaaatagtagaatcaagagattctacttttactattaatttataatttctatctcacctaacctattcctctaaataatctgaaattggctaaaacaattataaattctgcaaaacaacattgttgcaagaatttttagtttattgatttacctcttctccacagagtatgtgcaactttaaaattttgaaaattaaaagtgatttttgcaaccatctttgatatcaaaggcatgataagtaaactcttgcttaagtgaagactaatatgcatcttgtctaaattattaaatagaaagatattgtcaatgtatgtgtcatcattgtaaaaagttaagtggttatggacgggaaaatcacatctgttcttaccagttcattcttggtactatgactcatggctgattatatgtctgctgtccctgcttcctgttggaggaagttcttgaaggaaatgaccatattctcttcctttctggaaagttctttccattcctgacatagttggcttttctgagaccattttgcagtgaccactgccaaaacaaggctttgacagtgcagcttcccactgcctggcagtgcccacacctcttcctctcttctgctgctaactaaatacttgacagctttggcctgggccacccactgtcttacccttcttgctcttagacttagctttcagcacagttcccagctcagctcactttttgttcgttttttgcatttcctgcgattgtctcaggttagaatttctgcacccacccctaacccaagaaaccccacctttggctccccatgtgtccagaatctaggaactgctcatcactgtgtgtgaattaaactgaatgaagcgtggtgatgagaggactcggggacctaaaatgcattgtgatacatgaatattttgtaagggctttttagaccgacatagtaaaaaagaaaatttgcttcctcacaacaaagttttgatttatcgtttttgtttatttttaattttctagcctcattccataaggggatgctgaggttgctggaaaaaactagagcctgacgtatgttaggaagaaattattttaattttactaaagccaaaagataaccatagagctggttgcctgccaggtcccagagcacctcccttctcccccacttgggagtcagtctcagccatctccacggtgtggttctggagtaaagagagccggatggctcatgtgtctcagagatttcacaaagatctggttcaactcaggattgtgacaaaccataggccctggtggccactgtaaatataagggttaattaattcaccctttcatcctgtgacatattcatccattctctcaacaaaccgagccatgccctgggtactgtactaaggcagataccgagatgggtcaaatgtggttccagccaccatgatccagtatgacaggcgtgaagaagaggaagggcagggtgctatgggagcccagaaggcagctcctaacccagaaggggaggtcaggagtgagcttcctgcaaaagctgatgtttaaattagaggatttaacaagaagaatgagatggaggaggcacccagtcagaggaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggcgagaaccccacagagaaacagcaggtctgaaggctgggaggtgagaacccccaacagtggatctacagctctccagacaggatcatcttctgctgaccctgagaatctccgccatcaaaaacgttcatggaactgaggccacttcctgtctgggggcacccagctgggaaccctgtggcttaaaacctccctccgcacagacctcctgggactcaggcagctcgcctgtgtctgggcgagaggtcattgctgtaggggagatgttgctggaggcagtacgaggggcttagcctcagcgcacatcctgagtgggagaaggaggggcagagccaagctcccagtccctgcgtagcttcccagagtacccccataagacaaacaaagccccattctaacccactcttccatgtaatccaagctgggcctaccaccctcaacctccttccagaaggtaaggaggatcttactgtttgtacccccagactaatagaaacaattcttgcagtgtccccccagggaccaaatatgtggagtccacattcacagagcatctggggtgtcccacacacgtgaggcccagggctccctgcagtgagtctcgtggtgttgggaaaccgcagccgggcactggctggcttgcctcttagttgaccctttattctcctccgggtgtggctggctgcatgatttcgggctgggatcccgacacagacctgtggacatctgggcccatgccaagttggtgtatttcaaacccccagcaatgacagaaatgacagaaatgtcacttaaaacaatctcctgtctattaaggtagcacaattttttttttttttaaagaataaagcacaatactggcaggactttcaggaaataagcatgcccatatgtgatggcttcttatggtgttcctttctttctttctttcttgagaaagatcagacaataatgtaacaagagctatggaactgtttggcccaataatcccacttttgggaatacactacaagaaaataatttcaaagaaaaaagctaatatgtacaaataaatacacagcagctgcaactgcacacggtataaaactggaaacaaaccagacaaacaatagaggaaagagctaaacaaattatggagtgccatgaaatactttatggccattgaaaatgacaaggacagggccaagtgcggtggctcaccctgtaatcccagcactttgggaggccgaggtgggtggatcacctgaggtcaggagcagagatatggtgaaaccccctctctactaaaaatacagaaattagccgggcatggtggcgggcgcctgaaatcccagctactcgagaggctgaggcaggagaattgcttgaacccaggaagtggaggttgcagttagcttagatcacaccattgcactccagcctggacaacaagagcaaaactctgtctcaaaaaaaaaaaaaaaaaaaaaaaaaagtaaagaaaatgacaaggaaaggaccattttgacgcattaacgttggaatatttaagcaatgatacaatgtaaagcagcacacgcatgctgcatggaactatatttttgtaaatgcttaagtgttctacaaacataacaagatagcctaaaaggaaataagttgaatttaaatgttcactaggtcctttctttgcgttgctcaagttcatcatttacaaagcacagttttccttttttttttgagacggagtctcgctctgtcgcccaggctggagtgcagtggcgcgatctcagctcactgcaagctccgcctcccgggttctcgccattctcctgcctcagcctcccgagtagctgggactacaggcacccgccaccgcgcccagctaattttttttgtatttttagtagagacggggtttcaccgtggtgtcgatctcctgacctcgtgatccgcccgcctcggcctcccaaagtgctgggattacagacgtgagccaccgcgcccggccacaaagcacagttttcaaaagcagatgtctctttagaaggacaacaacccaaaggatgggatccctgggacatggccggggatgcgctgtcagagcattcgtttgccaggtcactttgtctctgacttgcacgtcatatttgcacacctccctcagccagaatgcatgctcctctgttctccaagcacagcagtccagatgaatgcaaaggaagtggcttttctcatctccgctgcacgtagtgccgggcaggaattgacaacaggggagcaggaaattttccatttgaattagaaggctaagatgtcccctaccttctctgggacaattggtccgtctgggctggcatttgctgtgtggaatggaaaggagttatgctggaggaagtgaatgagcaacaacctcatatcagggatatttaaggtctgacagctgagaagctcatcagcaacaatcctggtgcaaattgggagcttctggaaacagggaccaccaattctcctctcccaattttattatgattaggtcccaatcaaaagattatttgggccgggcaccggggctcacgcctataatcccagcactttaggaggccgaggcaggtggatcacctgaggtcagcagttcaagaccagcctggccaacatggtgaaaccctgtctctactaaaaatacaaaaattagctgggcgtggtggcacacacccgtaatcccagctactggaaggctgaggcaggagaatcgcttgaactcaggaggcagaggttgcagtgagctgagatcgcactactgcactccagcctgggtgacagagcaagactctgtctcaaaaaaaaaaaaaaaaaaaaaaggagagaaagaaagactatttgggaacagctttattgagctctaattcacatatcatacaattcatccatttgaagtgttcgattccatggcttttagcatatcccagagctgtgcaatcatcaccacaaccaattttaaaacatctccgtcacccctcaaagaaacccagacccttcagccctcactccctcatcctcctcccattacccccacatctaggctaccatgaatccactttctgtttctatagattttcctgttctggacattgcatataaatggaatggtacaatatgtggtctttgtacttctttcacttagcgtaatgtcttcaaagttcatccaggttgcagcctgtaacactactccattcctcgttatggcaaaataatattgtgttatacgaggagaccgcattgtattaatccactcatcagttgctgatcatttggattgtgtccactttttggctattattaagaatgctgctatgaacctttatgtacaagtttgtgggtggacgtatgttttcatttctcttgggtgtatgtctaagggtggaagttctgggtcatatcggagctctatgtttagcctttggaggaaccactgaattgttttccaaagtgactgcaccactttgcattcccaccagagtgtatgcggttcccatttctcccatcctcactaatacttgttattatctgtcttctttattctagcggtcctcgtcactgtgcagtctcacggcagttttgatttgcatttccctgaggatgcatgatgttgaggactttttcatatgcctgttggccatttgtgcatcttctctggggaaatatctattcagatcctttgcccatttttaaattcggttgtctttttattattgagttggaataattatttatacatattttaaatgcaacctctgtatcagagatgtgatttgcaaacattttctaccagttagtttcttttcactgttttcatggtgtcctttgaagcacaaaaattttggttttgatgatgtccaacttgtctattttttctttgattgattatacgccaaagactcttgccaggcttggccctatggaaacattctgtgcggggttttggaggaaatttaatttaatataaaatgtaatttaacttaaaactcctatattgctatcatattataaatccagttcgggatttagaaatgtataaactctgtaaatatgccacttacaactcattagacttttaacttacaatgctccaattcttggagaggaacattttgaataatggagaatacttcttttccccacagcagccgggggcctgaccctccattatcacttctcttaataacttcccagagcctccaccagtatcaaaagatgtcccaagtacctctcagaatttaatatacatatacatttcttcccacaatttccacttctagaaattgattctgaagacattcttacaaagatcactattcaaggatgttcaccgcagaattactttgtaaaagggaaaacataagcctcatctaaacctccatccatagaggactgaagaaattaaaattgtagtatggaagtctctggaacagttttaaaaggtgatggatctttaagtgttggcttcaatgaatattcacaatatattgtttacttaaaaaaatagaggtaaggtatggaaaatatacactatatatagttttttttttgtaaaaaaactaacttgttgggcattcacagctttttttttttttttttttgagatagtctcactctgttgcccagtgcagtggcacaatgggctcactgaaacctccgcctcccgggttcaagtgattctcctgcctcagcctcccaagtagctgcgattacaggcatccgccaccacacccgtataatttttgtatttttcggagagacacggtttcaccatgttggccaggctggcctcgaactcatgacctcaagtgatctgcccgcctcagcttcccaaagtgctgggattacaggcatgagccaccgcgcccgacccgcatgtcggtattaatagcagataaccaaagtgtgccaaggaaatatggctttgtctctattttcataattgacccagtcttcttcagggccccccaaggaacagaacttacattatctgggtaacagcttttcactttgctccagtttgaacagtctctctcagtttaaaccggtctctatccagtaagtactcagtcaattccagcttcaagtccccaggaggggtgttcctccgctcccttcctcctgctgggagcaggggcgagctcctggtcctctggactctgtgggccccaggccagggtgggtccctgtccccctcccgcggcagggcaggcggttctgtccctgggcgcgctgctgctctaccctgagggagatcagccgctcctgtccccaggaccccttggcctctgcacctggcacctgggtgtggggcttcatggctgttttcttgagatgctcagggcctggaagtcccccttgcctcacaggcccccttcgcctctcactggtgctgccgctgcaccgccaggtctggctgcacccggaggacggagaaccccacgcggcccggccccggggcccaccctgctctcgtggctacgccccgcttctcccacggccaccaccctcttcccccgcccccctccctggtggtggcctcgcacgtggcttttattcctctcttcctcccctgggaggggccgcgcgcaaccctcacccaggccctgggctccctccctccctcctgcagggccggcagcgcagctgtgctgcttccagccttgtttgttttaagctcttggcgcccctggaggggtccgtgccagtcggccctggtcctgactctacctagcaggggacttctgctttgcgggacacggctgactacagccccctgacccccagcccacgtgtcctgacggccccctcctctctcccctccacactctccccaccactggagccacccagtcacccctccagcgtcttgaggatggagacatctccgggccattgttcctccttgaatcactaacgcggtagcatttctacacggaatgccactttctctggccccagcccgttgttcacagatttggggccacagctgaccacagtcaaatagaaccttctccagcagaggtttgggagtgtggctgctttctcagcccttcaaggttacataacaggcacaaacccattttctttttttctttttttttctttttgaggcagagtctccctctgttgcccaggctggagtgcagtggcacgatctcaggtcactgcaaccttcacctcccaggttcaagcaattctcctgtcagcctcctgagtagctgggattacaggtgtgcaccaccacacctggctattttttttttttttttgtatttttagtagaaacaggatttcgccatgttggccaggctggtcttgaactcctgacctcaggtgacccacccacctcagcctcccaaagtgctgggttttacaggcgtgagccactgcgcctggccacaaaccccattttctatgtgagaaatcagacccagcttcattctgtcccctcctccagttctcccactgtgtctgtgcctctctccaggcaacatgtggttccccggccatgctgagtcctgtgctgcgcattggcaggtggaccagaccgtgagggcaaggtctgggacacagcctgtgagtccccagcctcgggcaggggctggctggggaggaggaggaatagacccatttcgctagagtgtatcctctgcagaatttgcatttgtgaagtgagcattttatatttttatttttttaaaacagttttcaccttaaatcactattcactttgccctctttccacacacgttgtttgttttgccaatccccagggtccactacactgaaaagtccttcagcatctgcagttgagacaggatgccaagcataatactttttttttttttagtttgagacagtctcactctgtcacccaggctggagtgcagtgacacaatcacagctcactgcagcctctcctggaagccctcaaacttcgggctcaagccattctcccgcctcagcctcccaagcagctgggactacaggtatgcaccaccacgcctagctaatgttttcttttttttttcttttcttttctttttttttttttttttttttgagatggagtcttgctatgttgcccaggctggtctcaaactcctcacctcagacgatcctcctgagtaggccttgcaaagtgcgggattacaggtgggagccactgcaccagaccacgccatgtgcaatactgaaataacatcagtcatggccatcgcagaactcatgcagagtacacacaacacgtgcggggacatgtgtgttacccgcccagggcccatcgccccttgaggcctccctgaaagatctccatccccaccccaacctcattgtgatccacactccctgaatatgtgtccccggggaggccaactaacctcaccccagtcaggctgggcccatctagcctgagagaagcctactccccgcctcctggtgatgggttccagaatggactgggacccagttctgtccaacaggaaatgagaacgcccagggcttcaaggaaatgtctcatcaggtctagaaggatccctgagaagagatggcccctttcttggcctggatgtgatacacagaactgccccagccatcctgcttccaaggaggaggtcagccctggtgacggcagagtggagaggtggagagaagtgggttcctgacgaaactgcaccccatggagccagccaccccgaaggctgcccggcctcctggcctcctgctctgggaacgtagatttgctgatttcacaagcccccttgcatcagcatttccagtacaggcagttcaaaatgtcctccttgatattcatgggcagggcccactttcttggaatttacttccagcaataatgatatgcaagtgaagttttatgcattaagaaatttcttaatgacttttacaatttttttacaggttaggaagtgagcatttcaaaccatctggattcacacctgagacctgagagaaaaactgtaatatgtgtttgattcactggggacacagagggtgggagtgccaggtcctgctgtcacctccagggcagaggccattgtgtctcagcatgtctgtccctcgtgcaggacccagtgtcaccgcacacagctgtgcagctctgatttcagtctctctgagcctccgctcacagtaaatggcgacagatctcttggggggttgttgtgggattagatgaaagaaggcatggaaggctctgtcacacataaggtgttaaacagtggtagtctattgtgtgttagctgggtagctaatgccacatttggtttaattcatgctgtaattgatcctcactgtgaaaaagaattatcatgtggactctaagcagctcagacatcatgaatcaactgggctcaacagaacgtcccaacagaatggtgtgcagaggagtttgcaaaccagcagtccacccgtggtgctggccctcagacgtgccttgtttgctttgtccagttttttctttaataatcgagccaacatttaaaattgtggagaattcacattaaaacaaataaaacaacagcaacaacaaaagccagatgagcagatttctggctcctgtgaagattccgaggtgttatgatagcaggggccacctgcctggtggctgccacccatagcaggggaggagtccagtcccgctgcctgctgctgctgtgtggaaactccttcccacagtgcccgccactgcaccttgactgacatcaaacccttaaactgcatctactgagccctttatttcaactagatgcgttcacacttcatagttctatttagttcttttttttttttttgagacagagtcttgctctgtcgcccgggctggagtgcagtggcgcgatctcggctcactgcaacctctgcctcccatgttcacgccattctcctgcctcagcctcccacgtagctgggactacaggtgcccaccaccatgcccagctaattttttgtatttttagtagagatgggttttcaccatgttagccaggatggtctcgatctcctgaccttgtgatcccctccccaccccagcctcccaaagtgctgggattacaggcatgagccaccacgcccggcccttagttctttaaaaataatggcttaaagctgggtgtgatggtggacacctgtaatcccagctactccgaggctgaggtaggagaaccacttgaacccagtaggtaaaggttgcagtgagccgaggtagcgccactgcactccagcctaggcaatggagtaagactccatctcaaaaataaaataaagtaaataataataaataatgacttattgttcctgttttatatgatcaatatcttccttttctattaaaataaatgatatatatacacacatactttttttttttttttttttttttgggacagaaccttgctctgtcatccaggctggagtgcagtggcaccatctcggctaactgcaagctccgcctcccaggttcaagcccttctcctgcctcagcccccccgagtagctgggactacaggcacccgccaccacgcctggctaatttttttgtatttttagtagagacggggtttcaccatgtaagccaggatagtctcgatctcctgaccttgtgatccgcccacctcggcatcccaaagtgctgggattacacgcatgagccactgcgcccagccctaaataataaatattttaaagtcctagtcagcctgttccaataattctgctttagatggtatatgttgttccactttttggcttttcttttatgatgatgtaccgcagggtgcctagttactttggtctctaagctcatgtttcccgggggcactggccactctgtcagggagtgcccatttgggctgaaggccagatcctagtggaggtgcctcttgggaagctaaggagcagggagggatgagctacagggcggggagacacggggaccgtagagctcctgactgaccacccctgtctgctgctgtgatggttaattttatacgtcaacttggctgtgctgagggatacccagacagctggtgaaacattatttctgggcgtgtctgtgagggtgtctccagcagagactggcatttgcctcggtggactgagtaaagaagacctccctctccaatgtggatgagcatcatgccatctcctgagggcccgaatagaatacaaaagcagaagaaggctgaattctccctttctctctctttccccttgaactgagacatccatcttcttctgtccttggacatcagagctcccggttctagggcctttggactctggggcttgtattagagcccttcctccaaccccagcccccaggccccaggggttggggttctcagggcttcagcctcagactgaattgcatcaccagcattcctggatcttgagccggcagagagcagatcatggcacttctcagcctccttctcataacccatgagccaaacagtagatcgcctcttctctatgcacagagagcctggggttctgtttctccagaggaccctaatacagctgccattccaccagacagcgcctttcctcttgtctagcttttaggctcttggaaataagtgacagggaggagacagtctccccatggagctgaagagggtgcaggagtggtacaacacccagcacagtggtggagcccatctgctttcctccacctccgtccctttcctctcctgaccctgtcctgccccaatatcggtgtcccagacactggccccaatggcctggactgctgctgcagatttctgtggtggatggggacaagcaataattattccacagcgccttgagaaatgggaaaaaacagaacgtgctatttttgttagttcctctaatccacacttctctgcggggtcggtctggaggtagagggccagaaacctatgggagtccacggtcttgctggacgcctgcgcccattttcttatggcaggaaaccacctctttgcaccagaggcggacttggtgatgctaatgtaagtgcgctccagggccctgcacccgcaggagtccgttccagatcctgggaggggcctagtaatttggtcacaaattggtcatgtttttcttaaaatttgcgagtaggatactttgcaatcagtcaaggctactctctcttccctccctgtctttcccctcaccctccttcccctcatgggggccagcgttggagcatctgcttttgggggatttgactcaggagaaatcgaatggggctacatttaattgaggttaggggcaacgtctctgtggttgacagttattcccatgcatcaggttgctggtcaccctcccactccctaccttgctgatgtgcccggcatcacagcctgcctgacgacgctggctgtggcacaatggcaaggtgaatgtggccatgggggctggccccagaactccaaaagcagtgttgtcagaggcaatcgaaccacagtgactccatcttgaataggcagtgggtaaaatgaggctgagacctcctgcattcccaggaggttaggcattcttagtcacagatgagataagaggttggcacaagatataggtcacaaagaccttgctgatgaaacagcacgtgttaaagaagctggtcagaacccaccaaaccaagatggtgacaacagtgacctctggttgtcctcactgccattatatgctgattataatgcattggcatgctgactcacatttccaccagcgtcaggacagtttagagatgccgtggcaacgtgaggaagttgccctatatggtctaagggggagggaccctcaattccgggaatagcccatccttttcccagaaaattcatgaataatcaaccccttatctggcatataatcaagaaataactataagtgtaatcagtgggcagccaagccgctgccctgtccgtggagtagccattcttattcctttactttcttaataaacttgctttcactttactctgtggatgcacccagaattctttcttgtgcgaagtgcaagaaccttctcttggggtctggatcgggacccctttctggttacagagtgacagacacaaggtttgaagtgtgcagaaccagatgctggcctgtggaaaatcttccaacctcagatacataaaactgtaagcagtagattctgttctcattaacacctcgtcgagatggaaggtctcgcccgtttcatatatccttcagaatgcatagtacatcatagtaaatggaacatatttcttttttatggaaatggtgtgaaatagaacttaccaaaattcccgtgtttgagggcacaaatctctagcagtacttcaaatggaaagtacatccgtgcgcgaagttgcatgctttatgcatcagaagtctcggatcgggccttagtgtagctgatgcatctgttgtccagatgaagtctggcagatccagatagaacagcatgcaaaattatcccaacacagtgaaataacccagagaaacaagtatttccaggaacaaaactacacatattcatcagtgagtcagtgtatttcacccaaggatttcccgcctgtgcggctcagcacaagcctgaacagtttaaatgcacttgaacggctcagaggaggcctgaatactgcatttcttttcttttcttttcttttcttttcttttcttttcttttcttttcttttcttttcttttctttttttttttttttttgagacgaagtctcgctctgtcacccaggctggagtgcaatggcatgatctcagttcactgcaacctccgcctcccgggttcaagggattctcctgtctcagcctcctgagtagctgggattacaggtgcgcaccaccacacccggctaattttatttttgtatttttagtagacagggggtttcaccacgttggtcaggctggtcttgaactcctgacctcatgatctgcccgtctcagcctcccaaagtactgggattacaggcgtgagccaccgcgcccagcctgtggctgccatttctaaaccaccccttccttgagcacagatcctctcccctccagcaatcctcccccttctctcaggcatcctccactctccgctctgttctggctctcacccatcagcatgggctaagggtcctccccgaaacaacacaccctctcttggcgccacgtcttgttccagccactaccctatctttctccctctcttcacagcaactcctaaaacaacttttctgtatttgcaattcccaatttctcttctccatttccctcaggaacttgtgcccatcaggcttgtgtcccatgggtcccctgaaacgggtcatttcagccctctccttagttaacccagtggcagcactccaagccactttcttcacttacattccagcccagagcgtttcttaggcagctgcatctcagtctctgttccggagtgaacggtgtcgcctcagaaagctctgttaaagtccgtcatgccacttcctcggatggtgaccttatttggaaataaggtcattgcagatggaatcagttacaatgagcgcacgctggagcacatgagtgtgtccttatgggaagacagccctgtgcagactcagagagaagacaaagggagctggggtccctctcctaagaagcttagcaattctccatgctgattcctatggatttggaggtgacacttccagtatcaccaccgggatggatttcctatttatctcgcacggttcagcagggttttgcatgcttgtcgtttcgacaaagaagacagaaagagcagagatggccattcaacctcagcctgatgggggagaggtaacgcagatgaggaggcaagccagagtatgagagacaagagggaggggagacttgacggtgtgtttcagtcatggatctagtccattctacaggtagcaccagtctggccctgcccagttatgtgtcaattcatgtcctttgtttttctttttgtagagacgaggtcgggctatgttgcccgggtgggtctcaaactcctgagctcaagtgattctcccgcctcagcctcccaaagtgctgggattacaggcatcagctcctacacccagccattgcctgttttttttttattacagtaattcatgctaagtctctgtaacttgcgcttgaaagagctcactgcaacctctgcttcccggattcaagcaattctcctgcctcagcctcctgagtagctgggattacaggcatacgccatcacacctggctaatttttgtatttttagtagagatgaggtttcaccatgttggttaggctggtcttgaactcgtgacctcaagtgatctgctcacttgggttttaggagaagggtaaaatatggacaaggaggccagtcataggattgtgagtaaaagcagcgctcctgggtagctgggcagatggaagcacactgcctgtcccctcccgtcacctctgctgtttagggagttctccaggggtcaaaagtcagggtgccacagaaatgtgggaagtacacagagaggaaatgtgagaaagaaactgagattcagaaatttaaaagagaaaactcgttgaacaggtaaatttgcggaactgaaatgcatttcaggacgtgcattcccaaaacagctaccttttttttaatgaaaaagggctctctagagtgataggcacgtatcaatttgctgtttccaaccctaccaggtgaccagagggctgacaaggatggataatgaataaagacaaggcgtactcatgtcctaaatctgctgtaagaagtctgctgtgggccaggcccagtggctcatgcctgtaatcccagcactttgggaggctgaggcgggtggatcacatgaggtcaagagttcaagaccagcctggccaacgtggtgaaacctcatctctactaaaaatacaaaaattatccaggtgtggttgtgtgtgcctgtaatcccagctactcaggaggctgaggaagaagaattgtttgaacccgggaggcagaggttgcagtgagccaagatcgtgccattgcactccagcctggtgacagagcaaacactccatctcaaaaaaaagagagatcttctgtggcttacaacaatgggaatttactctcttacagttctagggcccaggagccccacatcgaagtagtggtggggctatgttccctctgcgggctctggggcactccttgccttgcctcatccagcttctagtggcagttgtgtcaccccagtctctgcctctgacttcattcatgtggccttcttgagtgttctgtcttctgcctatgtcttcccatatttgtataaggacacttgtcactgggcttgggactcgccagataatccaggatgatctcatctcaagatctgtaacttaattacatttgcaaagaccctttttccaaataaggtcacattcacagttccaagtggacatattttgtaggggtcacctttcaacctacagcacaagtacttgcagccagtgaggtacatggcatttctgctcaggcagacgacgatttctagctttttttctctttctatttatacatggtggtggaaaaataagcatttaaagactgaaataacttctaaatgccttcctcttctaatgggtattgaaataagtgtatccattaagagacggtttttggcccgatgcagtggctcacacctgtaatcccagcattttgggaggtcgaggtgagcagattgcttgagcccaggagttccagaccagcctgggaaacatggcaaaaccctatctctacaaaaactttttaaaagttagctgggtgtggtggcacatacctgtagtcccagttactcaggaggctgaggcagcagagtcacttgagcccaggaggtcaaggctgcagtaagccatgattgtgccactgcactccagcctggctgacagagtgagacctcgtcaaacagaaaaaaaaaaaaagagagatgggctaggagcggtggctcatgcctgtaatcccagcgctttgggaagccaaggcaggtggatcacctgaggtcaggaattcaagaccattcttgccaacatggtgaaactccgcctctactaaaaatacaaaaattagccaggcgtggtgggtgcctgtaatcccagatacttgggaggctgaggcaggagaattgcctgaatccgggaggcagaggttgcagtgagctgagatcatgccatcgcacttcagcctgggtgacagaacaagactgtctcaaaaacaaaacaaaacaaaacaaaaacatggttttcaataattttcacacagccacacatataaagcacaccttgggagaggaggatccctgctggtgcgtgtggaccactgcaggctgccatgtcgataaaacagatcacaggagattgcaagttcccgccacagctcgataccccaccctctttcctatggctcagacactccagctttaggagccctcatgtttgtttctgtttctttagttcatgaggtgccccagcttccccagtttccaaagccacgcaggtgtatgaaaatcttcccccgatcttcttgcaggttatagttagaatattacctcagcaatccccaaggtggaagaaatgagaagcagaaacatttcattagtctagaacgcctacacgaagactatgtgcctgcagatatgttgacaagttttgaaggaacgccaaagggagtagaagatccggtcttgcttagaagaaattatttaaggagtagaatttctttgagaccacgagtgagcaggttagggcagtgccaggaacccttagggactcccatcaaccccagcatcagaaccttcttcctaggatgcagaagcatcagaaccttcttcctaggatgcagacatgagtgtgaggagaagttttcactctgccgtgatcaaaggccaggtgtatttcaacccctgaaggcatggtgtttcacaagccctgactggctcatgtaagcaaatataattaaatcagttctgtcaaagccagcatgtgctctgttttctttgttgtgatgggacagaaatcaagggccaaagatccacagaactcagttagattgcttacgggctctgaaagcacgaaacgtaagtgccgtttccctccatgttatcaggggagaggcacgggtcaaattacggcatatacaaataggccacgttcgaggaccttcatacttatgtatttatttttttacgtcaggtatcagtcattcagccttttttttcctttttccttctcactctccctttcctttttctttcccctccctcttttttggtggctgttgtttgcttttttatattacaaaagtaatacagcaccatccttttttacatgtagaaagtagaaataaaacaaagaaaagtcatctgtaaacttaccacagagggagacactctgaacattcctgggtgtgtttttaagcatactgtacatgtgcatttttaagcataaaaaagaaatttcttgaaatacacttatttggataaataatttagaagtattaataatttatttaatattattagttaatagtaatggctaattacttaatgttaatattttattgatgattttattctgaagcttttgctacatactataaaattgctctccagaaatgttctatcccctttcactcccactgggaatgtagaatacctgcttcctcgcgtcagctctcatcaaccttgttggataaataagtagacccaaagatctggtggtctcaggttttgttactaaaggcaaagctgcttattgtaaacataggagaaaagaaatctttctgagtggtgactggagctttctggagtggaaaggtattgtaaatgaaagaaagacaggtgccacctctactccagggttatcgagagcttgtctgaaatactttgtaatgaatgatttaggtcaatgagagggcgattccagtgaaggaattgtagtatcgagaaggcaggtgcgggcaagagtaagtgaatggccgttattgtctgagattaaagcagcaaacccttcaaatagagaacgcattgtgtgcaagagctgattaagaacacggctgaaagtgaacatcagtgtacatgggagggttgttctaactatagagtttgtgatttactccatgacatagaccttatcttgagtgagttatgatattttctgggtctcagccatgagccctcaatgagctgaccttattgtggtaaaataatcagagttcaggttagtcatcaccatctatctgggcatgccaaggaaaaataataaatgggcaactgtgtaatgcttagatttaatctcattaggaggccttcgtggtaaaattgtgggaactgaattacagtgaactaactctggaacctatgctgtaatgtcagaatcattctcttctattcaaaaagcaattatgcctaaaattaaaacataactgttgtaaactagcttcatgtttcaagcggcaaccaagcagttctgaaccacgagatgctgagtgagtagacacaagttgggactaaggtcaaggggtctgcctctgagcccctgggccactgagagggccgttcaggatcccagtggggcaactagtccgtccatcaaatccaagccctgcagacaggaaaattaacatgcatctaaggccttacaaaatcaaactatgggaaagaggagatgttgaaaaaaaagttgaaaatgaaactcaccattctaaacatgacgcctaccctcagatgtgagcccaccttgagttagccatggccggtggctcttcttccctcaggcctaagccacacctcttcaaaacttcagtctgcctatcctccgagtctgggtttcctccaacatcgtccctttccttctttcttccttcccttcttccttccttccctccctcctttctttcttccctccctttttctttcttccttcccttctcctttctgcctccctcccttctttcctccccctctctctcccttctttccttcctccctccctcctttctccctgccttcccttctcccttcctgctcatcttccacaggcaaacgtagggcgcactcagccccaagccccgttccacgctgcagcactagacacgtctaacgggcacggtttgcagcctgcctgggcgtccagcagccatgctctctctggacaaccaaaggcaagttctgctggagcctgaccgccagctcagtcccctccggggttggttcccgccattcctcttgatcacctctccctccctccccacctggctctaagggatgggtcgtcagagcccggaagggggcagctgtggagccgctgcctctgatgatttgtggctgagaccccgtgcaagcgggaggcccctgcgatagggtttcagtctgaagaagatctggagggaggaggcattttttctaagatgttgatgtttgagtagcagtaataaggacaagtagggcgtattgtttacagttgaagacaatgaatagtctacttctactcctctaatctgtgactgttacccctacagcaaggagctgacaagacgtccatgaagcaagaagacatggaaggggaggagcagcctctcccccctactctcccgccccgccccggcctgccccgccggcaccaaacgcaagcatcagactcacctgctctccggtgtgtgtgaccaagaaccctgcgggctcctctccaccctccactctcaggaaataacaggaaagatgtctccctggcatgcctggactcgtgcgtttattcactcagcccaggagtgcaggtgctcgggtgcaggcctggccccagcacttactggccacatgcctgaccttggggaggttgctgaagctttctatgcctagctccctcacctgaaaactgtggctattactagtccccaccccctaaggctggttgggaggactaggagataaggcaggtgaagggcttggcacaccataggagtccactgcatgctgtctcttgttggagagatggccatcaaacgcctgctatgatccagcgcagggacgtggccccttctcccagctggaggatgggcaagaaaaccacacaagacaacccatgctggccgtcggggtctggaggagcaaggtggacggacatccaatcaggctggggtaggagaagggactcaacagagattttgcagagggaatgaccgatcgattgaattcctaatggtaaattaggcttcaccaggtgaggagagatggggatgggaaaggggagaaaactccaggtaacgagtcgtttgccggtggttctctaaggttagaacagatcacaaagactctctgtggcaaagaggatgcagtcgaaccgggaagtgtctcttctgccatgggaagaaatttaaactttatcccaaaagccaagggaagaccctgaaggatcttaaacaacctgaccccctaaaggtgtaacaaaccggcattcgattgtccaccctcatccttatcatgtatctgaaagaaaacacaggggatttttttgtttttgtttttttggtcttctcaaaaatatttgtcgtaacacatgtctgggatgtgaattgtggccaatttttcctgaagcagtagttatgattttgtagaggcaactggccagatattaaatgcttgctcctgtgagattttttgtccccatctcttttctcatgtggtacaatcatttccgaaaaggacccaccaattgtctttctttatccgggtcctccacacggatggattcgtggcagggccttttgcaacatttagggcaaaccacttggctgagctgtcaagtcagcgcgcgggtaatcagcagatttattcgaggaaatatatttatggtcctgaatggctgttaaatggagccattatctggccttcttgctgttgctacaaatgtccctccagagcgtgggtacccacactaagcccatgatgcttccaggtcatgaattcaagacggtatttatgctgcctccagtcaatgcacacgcatgtgctgaggtcatgtcagtcgcgcttgttgaacgctgaggcacaaactcaatgccagatgctttattaaacattcccagggcaatcaaaggcagaaagagggagaaaaaggatttgttgaacagccagtggagacgaggggttgaaatgccgccctaaattattcatggcttgctctgagctgaggaggaatcataataagcatcctggggccattgtagaggacatcatctttcttctggccccaggggtgccctctccacaagagtgtaatgagaaaaagcccagccgagcaagaagcctggaccagtggaccatctgcaaggaacggcagggctggaggtctcgggttgagctttctgaagacctggcacagctgcaacgcgaccaaaatggaaactcttggtttccatgttctagtccccactttgcaaatatgctttgagacatcgatgctttgaaatttcttacaaaatgtctgtgctaaaccccagaataccatttccatatgttcttgttttgcttccatacctctaaagcttgtacaacagaaatgggaacagattcttaaagaacgtacccatttttatttatttaaagaactaattttgtatgtatagacataggcatgtgtgtacagaaatacagaagggttgcgagtatcagcaacttagatgcctccaaagtctgatatatgtgcacctttaatgaggagagattactatttcaaaagggaaattcttacagaattttcacattctaggggaaaaggcattgttcaatgtagcaggcggccagtcgtgttgactcacacctgtaatcccagcactttgggaggccgaggaaggcagatcgcttgagctcaggcatcccagaccagcctgggcaacatgacgaaatgtggtctctacaaaaaaaaaaaaaaaatagttgggtgtggtggtgtgtgcctgtagtcccagctacgtgggagactgaggtgggaggataacctgagtccagaaagtgtgggctgcagtaagccaagattgcaccactgtactcccacctgggtgacagagcgagaccctgtctccaaaaaaaaaaaaaaagtaggtggcacataggcttaagaaaacatttatgggccttttggtcaggaaagatgaaggccctgtccagtctgggtgacttgggattaggcagaggagagtgggagatgagggaattaaattgctcagttcagtaaagtaatgagaacttgggtgttctggcagttctagagggaaaagactctgtgggcctagaagatgagaagaggaacagaaggggctagaaatggagtgcaggcctcagaaaacatagcagggggcgctgccagaatgagaaggccctgggcaggaacagctggtagttagttgcaagtcattgcctaatccgagcagcacgtaggactcctcttgagccctaaactttcatcaaatccttgtgctgttagtgccttgggaaatgaagagagaggaattgaggccaccaaggaatgcaggccaccaaggaactcaggccaccaaggaacacaggccaccaaggaactcaggccaccaaggaattgaggccaccaaggaactcaggccaccgaggaacacaggccaccaaggaactcaggccaccaaggaacacaggccaccaagatgcacgaaaagcaggaatttgtaacaagagatcattgtgggaacataaggctgtatcccccacccccaaatctgggtaagtctccagaaggcttggtgagaccttgaaccttctgtatctagagcatgctggagagcctccagcaagtcacacgaagatggcaggaaaaggacattccaggggctggaggacgttaggagcatccaggaagctgaccccagatcccaatcatgcatagttttgtgtcagtatcagaaaaagaagaaaagaagtgcttgtgagtcatcatctccagattagctgttctgagtctctactgggcaccaaatcaacacctccgtctcccgttatagactaaattgtgttcctccagaattcatatgttgaagccctaacccccaacatgacttggagagtgggcctttaagaagtattatcattaaggttaaatgaggtgataagaatgaggttctaatctagtaaggctggtgactgtgtaagaaaaggaagagagaccagagacctgtctcgctgcaagcacagaggagtggccgtgggagggtacagtgagaaggcagatgtctgtaagccagggaaagaggcctcaccggaaatcaaccctgacagggccttgatctgggattctcagcctccagaaccgtgagaagatacatttctgtcatttaaggcacccgtctgtggtatttcatggtggctgtccaaacagatgcacgcagctcctgatgcacttttcttttcttggctattttttaaaatgttgctataggcctggagcagtgactcacgcctgtaatcccagcactttgggagcccaaagtaggcggatcacctgaggtcaggagttcgaggccagcctggccaacatggtgaaaccccatctctactaaaaatacaaaaattagccagacatggtggtgggcgcctgtaatctcagctactcaggaggccaaagcaggagaaacgcttgagcccgggaggtgggggttgcagtaagctgagattgcaccattgcactccagcctgggagacagagcaagactatgtaaaaaaaaaaaaaagttgctatagtttgaatgttctgtcccctccaaaacttatgctgaaatgcaatccccaatgcgacagtattgacaggtatggcatttgggaggtgattgagacatgagggctctgccatcatgaatgagattaggtgctcttataaaagggcttgatggaggaagttcaactctcttgcccttctgccttctgtgaggacacagccttcctcccctctggaggaggcagcatgaaggcgccatcttggaagcagagactggactctcaccagatttgtcttggacttcccagtctccagaactgtgagaaatacatttctgtttttactataattatccagtcttaggtaatttgttatagcagcacaacatggactaagtaaatgccttttcagtttttctgtttgataaaaagaagagagctccagtaggcacagttccttctttttaatttcttcaattaatgaggtgctagtttcccgtttgtctaattgaagccatttttccacctttcactagtgtaacacgtaattgcctcatatctgaagaatggccagatggcacaaacaattacaatatttttttcaaaatagaagtgattttattgggttttatactataagatgaattttttaagaaatatatgtctatttttttttaaatcagataatacagaaacctagagaaggaaataaaaatacctcattttctactacacagcttttttactttctaaaaatgcagttgtgtgcagttgcataggtggctttagtgtgttatagctctatattgtgaatatctttccaagtcattaaatatggagctttattttaaatggttgcatagtattctattctataaattctcataattcatgtaaccagtctctcatttttagactttttagaagccatgaagtcaaatgacctttgactgacatttctgcacacttagccaattgtttcctgggatgtattcatcctagaagagggatgcattcagtaaccctttaacacatgtgttgtcttctaacgcacagctggaatgaacactggagacagaacaatgatcccaaagacggacatggtccctcctcgaggttttgagtccagtggtattacacaaggcgctaaagtgtgatgagtgtttccatggggaaatacagagcattttggttaaaaggaaatgtacttttttttctttagagacagagtttccatcacaatgcaccataacctcagctcctgggctcaagcaatcctcccatctcagcctccagagtaggtgggtctacaagcatgtgccaccatgtcagctaatttttattttttaaattttttgtcgaaatggagcctggctatgttgcctgggcctgcctcaaactcctggcctcaagcaatcctcctgcctcagcctcccaaagcgctgggattacaggcatgagccactgtgcctggccagtgcacttttaaaaaggctcttgcaggtggggcacattggctcacgcctgtaatcccagtgcttcgggaggctgaggcaggaggatcactcgagctcaggagtttgagaccagcctgggcaaggtggtgagaccccgactctacaaaaaaaaaaaaataataatgctttttctttttcttagctggttgttcctccaggaactttgtgttaatgtgtacccgccccccccacccactatggaagcacctgtgccccaggtctttaggtaacctgcgaactcacgttgtcccgtctttctggcaatcccaaaagccaacattctcattgcggtgtaatagcaactcattattcaactaggtaaggttatttttctattgtcctgagcatttgtaagaagacacttagcaaccctaattgcgtttcaaaatgcaattcacattctgaaatcatacgtaagtcttcgcttgtgtatgattttcaaatcaagtgaagacttgtgtatgatttcaaaatgctaattgcttaatttcccgaagatatgcttaaatgtcacacctgcagcaaattgttcagaagctgaaattggtcccttgtagcctttcttgtctaaacctccctgacttcactatgctccatggcatccagccgtcacgtttcctcccacccacgcagggactgcttcccgtgctgctcctgctgagtactacccacccctgcaactgagagtttgcagaggcctctgctgccccctggacctcttctcacgaatgcatagctgttctttactttctgcacaaagtgcattcatgtggaaggctttgggtgagtggaaaaatggaatgaaaaggataaagggttgttgctgttgttttgagacggagtttcgctcttgttgcccaggctagagtgcaatggcgtcgtaatctcggctcatcgcaacctccgcctcccaggttcaatcgattctcctgcctcagcctcctgagtagctgggattacagtcatgcgccaccacggccggctaattttgtatttttagtagagacaaatttctccatgttggtcaggctggcctcgaactcctgacctcaggtgatccacccacctcggcctctcaaagggctgggattacacgcctgagccactgcacccggcggcaaagggtttaaatagtgatccactctgggagaacctgggaaagttggcaaatcccacaccaggtggatggatccatggctacaggcatatccatcatgtggccccgtaaatcagtatgagaaagaaagtgccattcattcatacaactaatattttttgagctcctaatctgtgtgaagcctagtatctgaggatataacgtgtgtttatagttctacgaagatcataaattgttgtatttcagttactgttatactaggggacctgcagacctggaaagccattcccaggagggggcgttggtaggtcccacgaaaaggtgaacaagttcattgcatcagtcctcagggtgacccctcacgtgggaaagcagaactgaggggaagagcactagggggtggggctttccttggaatcaaggaggagacagatggaggactgacctgagatggccctgtcacctacctgtcacccgctgcacgaggccggcccctgcgcctgtgaggctgcactgtgccatggagcgagaatttccccgtggtaggatcagacctctgtctctggaaatctgacttttgtatgctaccaacatttttctgtaactatttcctctttgcttttctttgtcaatgcccttttgaaaatgccaacttgtctcctttgtactaagagacaccaaggaaaggaactgtgtgcgtgctcaggttgggtagtcccctggggacagtggattagcagaggaatcaaagcctggggacgatgagggctttcatctttctcacaataccatccatcctctttctcttcctcttcttcctgcttcctctttctcctctttctgtttatttttatctctggccacccctttccagcccctctctagctcagtgacaagctgagaaagagccagacctcctgagaccccatgaagaaacaatactgcacaggaagtttgatggtgacccccagggctgccgccagtgggaatcatcctcccaaagcacagaagggcttaccgcagcccttcctgaattcttacacttccacgggagaataatatcactctttgatttaattatagtagagctttgctctttccatgcaggaaggccttagtgatagggcccagtgagaaaatatagaggctgttctcagcagacctgataaatcctgagccacgctggaagaacagtgtctcaggtgtttgattcatttcaacacagttcctgtattattggattttccttgtgattttgtgaggttttcacggatggtttggggtgtttgcattcttgctctgacagggaagatttggttctttgtctgcgcaagaaccacacagcatcccgagcctggagcaaatcaactcaaagatacacccatcctgggcaggtggtttacaagggcagtgctgacagccaggcacaggtactcggggtgcagagcggggacaaatcaaaccacgaccccagtgcttgttgtcagcgttggctacacattattggaattcagaaaagattcaatcgtgtgcgaactattgtagcttgatttgtttatggacttttatttttagactttaaaaacgttcccaatgttaaactctccaggcagatgtacggtagcaatacagttacacgaccagcaagctgacgacagccagccagctcctaaaatggtttaaaaccaatctctgctgtcaccttctctcagatcaaacccagagtaaatatccatagtctttgctgtctgtcactaaaggtcagaacagataccaagatgtaggaggctgatagcaccagtgcagtttggagctgaaatctgccctatagtacccccagatgagagcaaagtcctctttaaaagctcgctaagaccaggcacagtgactcacgcctgtaatcccagcactttgggaggccgaggtgggtaggttgctcgagcccaggagttcgagaccagcctgggcaacgtggcaagatcctgtctctacaaaagatacaaaaattagccaggcgtggagacgtgtgcctgtagttcaacctacttgggaggctaaggtgggaggatcacttgagcccaggaggttgaggctgcagggagctgtgattgggccattgcattccagccggggcaacagagtgagaccctgtctcaaaaaaaaaaagaaaaaaaaaggcttgctaattgatttgtgagggccagcagttggaattgcctccctaagcacaaggaagtaatgccccagcatgaagcaagaagtcagaggacctggtatacagctaggacttcccagctgcacagcctcgagcaagtgcgccttccagaacctcaagctcccatctgaaaagaggagaaatgatgcacacttacagggtttagagggtgacatcattcacccaacacgtttttactgggtccgaaatgtatgctagaaattgttttaagcactgtggatacaactgtgaacaagacagatacaggccctggcttggtgtttgaggtcatgttggtaacactgagacgtgaatagacagtattaatgacagtgtcatcactgcagtgggacgggagaaattcaggatgccacagcccttaacacagctaggggttgcagacagccttctagcatcgagtcttccacactgaatgccaaaggctgaatcagaatggcaggcatttgcagggaaagtgtgcgcgatgaggagagggagaggacgggaggggaggggaggcgaggcccaggcctggtgattcctgcctcaccccaggtcagtcccgcctttatacccagcttggagggtaaggcccgggggaaggtagctgggtgagctagctaggcgaacctggaggccacaggctcccatctctcaaaggccgcatctcccagaagcagggcggtgagcagtgctcccacagaggaaacccgaaacatctgctggttctgtgagttggttcgggcaatttattcagtgaattggtttctgttaggtctggaggatacttttagacaattcagaagtgcttgtctgatctaaaatactcactgacctgggtggggaagcaattcagtggccctggggtcttatttaacaactccccgcaccgtggactctgtcgctcctacccattcatgacccctccttaattagcccgggcaagccgtcaggtgaccccagccccagccaatatctgatggcagctgcacaagagaccccaaggagaatcacctgcacccaggcaggccactgaacctgagagataaacatatactgctgttttaagccactaggtttcggggtgagggtttgcacagagataaataaccagaacaaaggacaacctcaaaggtagctgttagcttgggaggccgaggcaggcggatcacaaggtcaggagatcgagaccatcctggctaacatggtgaaaccccgtctctactaaaaacacaaaaaaattagccaggagtggtggcaggcgcctgtagtcccagctacttgggaggctgaggcaggagaatggcatgaacctgggaggcggagctcgcagtgagccgagatcacaccactgcactccagcctgggcagcgagactccgtctcaggaaaaaaaaaaaaaaaaaaaaaaaaggaactgttagcactgtggtggcatcagatttgccaaggctgacactctgcctaaggaagctgtagcgtaagaaattctggttttgtttttggtgtttgtttgtttgagatggagttttgctcttgtcgcccaggctggagtgcagtgacatgatcgtggctcactgcaacctccttctcctgggttcaagcaattctccttcctcaacctcccaagtagctgggattacaggtgcccaccatcacgcccggctaatttttgtattttcagtagataccgggtttcaccatgttggccaggctggtctcaaactcctgacctcagatgatccactggcctcagcctcccaaagtgctgggattacaggcatgagccactgtgcccagccaagaaattatgttttaaagaaataaagtaaggcctataaaaccactgtcttattacaggtacagcttccaaggcactcataagcattcagagagtaatacctacttatcaggagccccaaaacagaataaagaaaagagaaatgttggaaataactaccttttaaagataattaggtgtcaaggcaaagcatcctaaaatttatagtgtgaataaataagaacattacgcaatgaccaaaattagattctcaaccttccaggaagaaacacagatactagacagcattaagtacactcacacttcaaaagttacatctcacaatcacagtaatccaggtcacttcgatccccaacctgctttactcgacatcagccagcctggggtacaactaaggagaaacagaattgagagttgaattttccaggttggtcatctacacagctccacttcaccggacagctgctaaactcccacgttgacacctgtcaagaggagcttctgctatttttgcaagtttcaatgctatttgagcaccgatacgatgccgcaagtagaaaattccacaactaacctcaagtgagactgacaggttgcagttaaaacacagtcaaaactgaccaggcacggtggctcacgcctgtaatcccagcactttgggaggccgaggtgggcagatcacctgaggtcaggagttcaagaccagcctggccaacagggcgataaccccatctctactaaaaatacaaaaattagccaggcatggtggcacatgcctgtaaccccagctacttgggaggctgaggcaggagaattgctttaacccaggaggcggaggttacagtgagccaagatcacgccactgcactccagcctggatgacagagcgagactctgtctcaaaaaaaaaaaaaacagaaaacaaaaaaaaccaccacagtcaaaactttgtttcatgcataaaattactaaaactattgtattaaattaccttcgggctatgtctataaggtacatatgaaacagaaacaaattctgtgtttagacttgggtcccatccccaggatatctcattatgtatatgcaaatatccaaaatacaaaaaaatccaaaaaccaaaacacttcttccccacccccaagcctttcagacaagggatactcaacctgcggttcaataagagaatccattaacccgtgcaaccaccaaaatgtatcagaagtaaaataacgtgcttttcagatattatgagagattgctgaggatttagaaaacacttacacttttgattttgtaaactaaggcttgtaaaccaaagcgtctgcccaactttggattctctcagcagagcatcaaaatacgatgaaagaactggagtgagtgaactgtagaaaaactgacagcatccagttgagggcgagacatcaccgcacggggaagcctgcttggtgtgtcaggcggaagagcactgagaggccactgcagctgggtgagttttgatgagtgtgcactgggagcaagtcaggtggtgttagggttctgacgaggaggtgggctgtgaggctggcctgtcttgaggctagggaagaataaggtaaaggatgctttgatgtttttgtttaaagctttggctcgataattcaataagaagatccattaacccatgaaactgtgaaaaggtgtttggagtagaataaagttgcacactttttcactattttgggggatttagaaaggattgatcctttttgttaattggcattttctcgtaatcaaagagggatggaagctccccctctaattggcagaagtgaaggagaaagcaggcacgtgaaacccatgaaaagaggcgggattgtcttccctactaaactgttgctcacatgtccttaaaaaattagtgtctcatgtaccccataaatatgtacacctattatgtacccacaaaaattataaattaaaaaaatggtatttcctggtgaatgtctcttagagaaaaagaaaaggctatctctgacaaagaagtcttctactttaaaagttctaggccgggcatggtggctcacacctgtaattcctctacttcaggaggccaaagcagggagatggattgagctcaggagttcaagaccagcatgggcaacatagtgaaactccacctctacaaaaaatacaaaaattagctgggcccagtggtgcccacctgtagtcccagctactcaggaggctaaggtgggaggattgcttgagcccaggaggtcaaggctgcagtgagctgagatcacaccactgcattccagcctggcaacagagcaagacccagtctcaaaataaataattgattttaaaaatttaaaaagttctggccatccttagcttttgagaactgaaatgtaaaattgtccaggtaaatggattggtcgagtagaaagaaaacaaatcaggcatcaggagctctcaattctatcttcagctccaaacaagaaagctgttccaagctccatccagcaaaggtgagagggagcgaggcagggaagagctattggctatcaatgttttcggagactctaagaagtgtgagacatttgagcagtgaacatttcagaaataagagagatgtgataaaagaccaggtggaggaaaaccgatggtgttgaggccgctgaagagaggcagctaaaaatcccatggagaagaatcagaaagaaaaatatagccagagaaaatgagggaaagggtggagtgggaatatgtaagtttttagcggctcttcagttagcaatgactccaatatgatgagaaaaatgaaacagaatccattcaaaagaaaaatgagctcacagacccaaaaagagcaatgttttatagcgcattgcaattttttgttctaattttctttgtgatggatgttttcagtactaggctcagaaagatatctttattaatacaatatttctgatggtttcccttctgtcactaatgatgaaagggaagccaccacccatatcagaaagcacttcgggggattctgaaagttatgcggctgggggtaaatgctggctcttccgtgcttgcaggcgctggtcgtgcaggtgtttgggatggggtggagtgcgggtgttggtactgtagccatatccctggcctcactctcctcccagtactgcaggtgacgtccgggaggggtggggccctcctccacagctacacttccccacgctgggcatgctccacggaaggatgggcgttgattgcctcaggtctacaagtacagaagggctgacaaggggatcacaaaaagaaagaacccgggacccatctagaagcaaaatgagctcatagagaaaggcagaaattaagcaaatgtaaagatttacaggctatatggcctgaggggaaagaaggcttgagctctgctggaaaatttcctcctgccaggtgaggtcagctttttgttctgttcaggtcttccactggtacagagaaaaatatgctttattcaaaatccactgatttaaatgtaaatctcatccaaacatatccttacagaaacacctgcaataatgtatgaccaaacatttggacactgtggtccagggaagttgatacataaaattaatcattgtaggaaccaagctgaaattatttttttaggaaacataatatgtaaaacaaaagaaaatatataatatattaaacagcagagaagtgtaagacttgaaaccaaagaaaagaaaagtgtaatatctgaaacaaacaaaaaatccattggatgggcttaaagcagaatatagatgacaaaggaacaggtcagtgatcagcagaaatagattaatagaaattaattaatgtaaagaaaaggcagaaaatggatttaaaagagagagagcctcagaaacatatgggactctatcaaaaggtcaaacatacatgtagttaagattccagaatgggtcaaatacaatttgaagaaagatggctgaaaattggtaaaagtatgaacttccagattcgaggaaatccaagaacctcaaccacaataaatattttccatgccaaggaatcacataatcaaatgctgaaaaccagaggtaaagagacccttgtttgggatggtggctcacacccataatcctaacactttgggaggccaaggtgggggaattgcttgaggccagaagttcaagaccagcctgggcaacacagcaagaccctgtctctaccaaaaatttttttaaattggctaagcatggtggcacacaccagctgcttgggaagctgaggtgggaggatcacttgagcccaggagttggagcctgcagggagctatgatcccaccactgtactccagcctgggcaacagagtgagacaccttatctctaaaaataagagagagaaagaaatacttgtgtattaggctgttcttgaattgctatgaaaaaacacctgagactgggtaatttattttttaaaaaagaggtttaattggcccttgcgtctgcaggctgtacaggaagcatgattctggcatctgcttggcctctggggaggcctcaagaaacttacagttatggcagaaggcgaagggggaactggtgcttcacatggtcagagcaggagggagagaggggagagctgccacacacttgtaaacaaccagatttcataagaactcactcatcatatagtaccaagagaggatggtgctaaaccatccatggaaactacgctcccatgatccagtcacctcccaccaggccccatctccaacactggggattaaaattgaacatgagatttggggagggacacggatccaaaccttattaccttgaaagaagacaaagtgacatctgggaaaatgatgattcaagtaatcactgactgctcgtcagaaacaatgggaggccagcagtcagcagtacagtcttcaaagtgctgaacaaaaaccattcaacccagaactctgtattagttaaaaatatcactccagaatgaaagcaaaataaatacatcttcaaatcaaagaaacccaagagaagtcactgccagtagacttgtactacaagaaacgctgaagtcagttcttcgggcaaaaaagaaaattacatctcatggaaactcagatttccaggaaggaatgaaaaacactcaaaatgtgtggatacatataaaagacaatttccccttttaactacttgcaaatgcatatgactgtttgaggcaaaacttaaaacattatctaggcctacgaagctgaaaggctagaataaccgcccggaagctgatttagtgccagtgcttccacagcacagggagacctgcatggtgcctgtcatgagattctgtagaccatgaaggggacaaacactgtggattccataagtgccccaaacctcagcccacataagtgcagcacctctgtgatagcaggaactccatgcagagtggtttatggagctttcaagttctgagctaggctccagttcagacaccctcggcagagggttctcacaggctgactttgcattcacacggactatcttcaattccgcatcccaaataacagccacaatttacttacatctgcaaacagaggttatcttacttttttgctttctgctccttatgccttttttttcttttcttgccttattgcaagtgctagacctcaagtagaaatggagacattgggcatcctcctttgtccctgatcttagggagaggcattcagtatttcaccattaaatatgaggttagctctgggttttttatagatgcccttgatcagaatgagagagtttccttttctcctatctggctggtagttttttgtttgtttgcattttctaaaatcataaatgaatattgaattttttccaaatactctttctgcatctattgaaataatcatgtggtgtttctcttttattctgtgaatgtgataaattacactgattgttgaacgttaaatccactttgcactgctgggataaaacctacttggtcatgatatttaccttctatatatattgctggatttgattcactaatattctgttgaggattttgtgtctatattcatgagggatattggcttctaatttttttgcttatgttttgtctaatttggatattagggctatgctggcctcataaaatgagttggaagtgtttccttctctatttttcaaaaagaggttttgggggttttttttcttatgtatttgatacaattcaccggtgaaataatataaacctgaagttgtcttttttttcttttcttttttcttttttttttttttttttgagacagggtctcactctatcacccagactggagcacatggtgcaatcaaggcttgctgcagcctcaagcttctgggctcaagtgattttcctgactcagcctccaagtagctgagaccacaggcacacgccaccacaccaggctaatttttttatttttagtagagattaagtcttactatattgcccaggctggtctcaaactcctgggctcaagtaatcctctcgcctggcctcccaaagtgctgggactacacgtatgagccaccacagctggcgggatctggagttttctttgtgaagtttttgataaattcaatttccttagtagacataaggctattctgattatctgtttcatcctgtgccagtttttatgttattcaaggagtttattcaatttcatctaaatagttacatttgggccaggtgcagtggctcacgcctgtaatcccagcactttgggaggctgaggtgggtggatcacttgaggccaggagttcgagaccagcctgaccaacatggtgaaaccccgtctctactaaaaatacaaaaaaaaaaaaaaaaaaaaagcaaggtgtggttgcgggcacctgtaatcccagcttttcggaaggctgaggcacgagaatcacttgaacctgggaggtggaggttgcagtgagatgagattgtgccactgcattccagcctgggctacaaagtgagactctatcttaaaattaaaaaaaaaataataaattgttacatttgttggcataaagcttttcacaacattcccttattattcttttaatgtaggatctgtagcaaccgtaactctgctttcattcctgatagtgttaatttgtgttcattcatcttgtaatacacatcagcacttcatttatttttggtgctgaatactatttcatcgtatgaatataccacacccgctttatccattcatcaactggtggacatttgagttattaatactttttggcttttatgactaacaatgctctaaacattcacatacaagtgctcgtgttgactcctctagctagtttgatttaaactggtttgatcccaacagacctccccagttacacccagtctcagtttctcactgctgtgtaattaagagattcacttgcttcctgtccctgagagtcaagggatcatgtagcctcagctggattaagcctggggcgaaaccttgaggggccccagacatctgaaggctcaggcaagctggcctgggagtccctgagctgttgcaggaggtccagaaaaagccacagcaggtgcagagttttattccttggttggaaacccttgcttaggaattcctagcgatatgcaatttgtcaattcatgttaatgaactcacatactgttaacagtatcatttttgccctttagactggttttgttcatgtgctcactctttaatccctggaaatccttcagaataccttgttacattctggaagattttaccccttggaatccaattcctcttctgcaatttgcatataactccaacagacaaaatgccaataatgcttcacattaaatgaaaaatcgccaagtcccttgttttctattttcctcttaaagaaattgtgggtgaagctgttgaaagatctttatatcgggtaacagaccaggtcttgaatttgcttaataaggaaagaaaggaaggaggagaagaaggttaactatgtgtgaatttatagatgttttggtgtctggagtccacgtaaataatatattacctcgctgtaaagatgaactctgctagagtctaggtctttaaacacaaattagcaggagctccagggaaggaagagatgttctgctcttaatgatctttttaacactagcggcaggtcctgagaaccccgcagggaattcctggaacgtgtagtccttaggatattggtatcccgtattgaatagtctgtaaggcgggggtcgggagaagaaatcctctctataaaataaaaactaaaacactcaagcaattaatcctttaaggacaattacaataattggtattggcctggagactccaggctttgaaacattcagcaggtaattttcttcaaaggtaataaaagtggaatatttgaccacgtttattagcagggacaaggcttgtctggggacacacgattcacacgtccttccaatgtgaatgaaactcagcctttttgtttttgtttttgtgttattgctgttgcgctattctgccctccaagtggaccctctggggcccactttttcagcttccacagaagtgagagcacgcggggcccgtctttctgtgcctgactgactccacttcacataaaggccccgctcccccgaccccggctccccgccccgcccggctcacccacgttgccgggaatgatccgttttccttcttttccatccaccttgactttcttatctcttattctggcctctctgcaaagaccacagcaggaactcctgcgctccccaccggggtccctcctcctcgcctctgctcccccgctcctccccctccccactgtccacctctgcccggtgcccaggcttcccccacgccctcttccttacccgcccccagcgcagtggctctgtgggggtccccacgtgcctgtcccccttccacccccaccccgcccggcccctgcggtgctgccccatcccccactccccacctctctgccacccccctctgcgatctcatctcccggggtgtccctgcccactgccagatgcctcagctgctcctgcccttcctcttcctccaggctggtgacctctgatactacctgtgtgacttttgcaacttgcttaccttctctgagcctcttctcattctagatgagaatatttggaggatcaaatgagacctactaaagatgcccaatagaccttagctagttcgtacctgcctgactgctccttgtgcccgtcatttggtgctgggactcttcactccacaccccctccctcctctcccaggccgtaaaggtgcatttcagggactgggtaatgggcacagccctaagtaagctctgcattcacccctcagattagggggaacagcttggctgattgggtgaaggcactgcaggccagttatctggttgcaaaatatattttatgggtttagaaacaaaaagaactatttgtgtatagtgtttaacaaatatataattgattatgggagaaagcagcccttccttccttccttcttctctccctccctccctcccttccttctttcttttctcatttggaaacctaaccactactgataacattatttccaaggcatagatgattggcagcaggtgatggaacccgagttttcctaggcctcccatgtctggaggaggtaatgtaaagaataattacttggtattcaaaggctcttgcctctacctgctaacacaagagtgcacgcttgtcagcagagctgctaactctgctaacacagaggagtccccgctatgcccagccagctctaggacttcctgctagagctgccactgtgttgccaagcaccatgcctcatcttgatgtccccagggcacaactgtagggatgtcactgatgccctgagttctcatggttccaaacctgtggagcagtgaactccacactcctccaaggggagtgtgccaagaccagcttgtagcaggacaagccgcagacaaaaccctcagacaccaagttaaagaaggaagggctttattcggccaggagcttcggcaagactcaagtctccaacaaccgagctccccaagtgagcaattcctgtcccttttaagggctcacaactctaatgaggtccgtgtgagagggtcgtgatcgattgagcaagcagggggtacgtgactgggggctgcatgcactggtaattagaacagaacaggacagggattttcacagtgcttttctatacaatgtctgtaatctatagataacataaccgattaggtcagggctcgatctttaactaccaggcccagggtgtggcgcggggctgtctgcttgtggatttcacttctgccttttagtttttacttcttttatctttggaggcaaaaattgggcataagacaatatgaggggtggtctcctcccttaagctcagtcgtggagaccctaacccagtggcgctagaggaattaaagacacacacacagaaatatagggtgcggggtgggaaatcagggatctcgcagccttgagagctgagagcctcgagcagagatttacccacatatttattgacagcaagtcagtgataagcattgtttctatagattatagattagctgaaagtattccttacgggaaacaaaggcatgggccaaaataaagggatgggctctggctagttatctgcagcaggaacatgtccttaaggcacagatcgctgatgctattgtttgtggtttaggaacacctttaagcccatttctgccctgggtgggccaggtgttccttgccctcattccagtaaacccacaatcttcagcgtgggtgtcatggccatcacgaacatgccacagtgctgcagagatttcgtttatggccagttttggggccagtttatggccagatttggggggcctgttcccaacaggcgtgggtcctaaggtgctattgcccagccccagtagttgatagagcgtatggaggcagagctttctggttttcactctgaccttctctctctctctctaggctcatgtgtgtgcagtagcctgggccaggaactggctggagtaagagctccaccctccccggcattcagggcctctttggggccagtttcttgttctctccggatgagtgtctctgggaagctccccagcctttgcacatggagctctccagcagaaacccaggctgagcccctttctgggaagctccccagaccctagcaaatacatttctgttgggcctgccctgcttctgcactgtggactgcagaagaccacagttccagtgaggactcccccacatgctcttacacatagctattttttgtaagctatgtgtaagcttctgtttttcaaacattaacaactgcctatccaatggttccttcaggtatacatgcactatcataaagaattattcaggcggtggctcatgcctgtaatcccagcactttaggaggctgaggtgggcgtatcatgaggtcagaagatcgagaccatcttggctaacatggtgaaatcccatctctactaaaaatacaaaaaattagctgggcatggtggtgggtgcctttagtcccagctactcaggaggccggggcaggagaatggcatgaacctgggaggtggaggttgtagtgagccaagatcgtgccactgcactccagcctgggtgacagagagagactccatctcaaaaaaacaaaaatatattcaaaataagttgggagagcttcccaatagttgaacatgtggaggtccctggagggtggcatggaagctctccgccccttcccccatactcaccccatgcatctcttcatctggatcctttgtaatatcctttataatgagctggtgagcattactcttctgcaggtcagaaatgttcccagatgctgcggtcatttcagtttgatttcattggagatactctgacttgatgatgatattaacatcactgaatccttcaaggaatttgttgaattgctcaaaaaggtagaggaagagaagatgacgatagcacacatgctagtgattttctcatcagacccctgggaagcttccagaaggagcaaataggcttcacggaggctgtgtgaggatgtggtgagaagatggccatctgcaaaccaggaggatactctcaccagacaccagtctgctggtgcccagcctccaaaactgcgcaaaataaatgtttgttgcttacatcctaaataaataagtaaataacaaaataagttgggcaatcatttaaaaaaaaatacctggctatggctgggtgcagtggctcaggcctataatcctagcactttggaaggctaaaggaggaggattgcttgaggccaggagttcaagaccaactcaatatttaaaaaacaaaaacggaaaaaatttggggcaatagtcttgttttctagtagagtctttttgcaaataatgctgtgatgctatccatgttcttgagtctatggggaaaaaaaaaaagatcggccctgaccctgtttgatacagatgaaaatcgatttcctatttggaaatcttacttatatcaactacaacaggaagaccctaatcctcgaaggattatctgtactttcaagggagaaaacagcccaaagtatcatggaagagagtttcacggcatgatctctggagaagcagctgaccagctcttgagtgtggctgagggagatacatcatggggagaggcagcaaaaggcagggccctacactttagctttcagattgggaagtcaaacaagaaacttcaggttctagtgcgatggaaatcactttgctgggaagaaacactgtgtgtccatccacaatctggtaactgatggcttgattactctctatattgaaacaaggcagcagaatacattgccaagatgatgataaacccagtttatgagcacataggatgcacaaccttaaacagagagtctgtttgcaaaaaatatatgccagtcctgaaaaagacacgtggtgagattctataggccaggatgaggtgtcggagaaaagggtgacatcactcgttaggagagcaactctgaaagaaaacaagcaaattccaaaatatgaaaaggttcacaatttcaaggtccatgcatcgagaggcccacgctggcatgaataccgtgccatcctcatgtatggtctcattgctcagggagtgaactgtgtggattgatttcagtgttcacaagcagtgacccaacatggtcccaaatgactggaagccaggcttgaggcatgccaacgtgtccagctgtgaccttacaatgcttgtcaaaagcacacactgctaagcagccaagggtggcagacatgtgcaacagggagattgagtctgaaagttccagttctgaaggactataccatgtatcaggatttagtgacttaactgatgtcaagacagcttttgacagatggtgagaaagcagctatttctgtgaacacatatgaagataccaacattatcactggaactccgaaactgcacttcagggatttgccagtttcactaattgcgcaggatatctaccgtaagtttatagaatctgccaaaactacggatcctagtgagtaattggaaacccttcatgaagcattgaaactactggcacctgctcgctgtgaaaccctctgatccctgatggcgcgtctaaagagaatgacgctccatgaaaacgagaatcttatgaatgcggagaaccctggaattgtctttggcccatcccttctgagacctccagaacaaaaagccatgcccacactgaacgatatacaatatcagagactggtggtggagctgcctatcaaaaacagcgacattttactttaaattttacatttgaggggaaaataaatgttttacagatgaaggcatgttttatagtaatttaattggctcctatagctgaattatttcttgattagagattcgggcatataaccagattaaaatgaaggaactttctgttgtttaactgtcttacacaacagtgaacacacactttctggtgctagcaatgctgggtgtttatcacattaagaaaaactcaagctattgcatgattagcccccatctggcagaaactccatacagaagacacaaaaaacctgccccagcacagcctctgtgtcctgcgtaatctgtggtggtaatccagcatgtttcagaataagcctgttgtgactttgctttaggatctgtgtcattggtttctgatgcttgtacaaacatgcacactgaaatggataaaacagtacctctggctgttacgttaccagactatatcatatgcctattttttgcaaatgacttctggtttctcttagatcctctctaacacagcactttttttttttaatttttttattttttttttgagatggagtcttgctctgtcgcccaggctagagtgcagtggtgcgatcttggctcactgcaacctccacctcccaggttcaagcaattctcctgcctcagcctcccgggtagctgggattacaggcacccatcaccatggctgactaatttttgtatttttagcagagacggggttccaccatcttggccaggctggtctcaaactcctcacctcatgatccatatgactccgcctcccaaactgctaggattataggcatgagccaccacacccggcctaacatagcactttcttttttttttttttttttttttttttttgagacagagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacatagcactttctttccaccaccagcaaaagcaaaatgtgttttcagatttgttactttaataagttatccataccaataaaaaatgtacaacacagaaaaaaaaaagaaagattaagattctttgttggtggagagggagcaactggaccctggttatgaagccatggctccaaagcacttggtacttcctccagcagaatcagaggatggagggcaaaggaaaggcttgtgaggacacacactggccacgtatgtgtcaaatgctgaggacagcagggaaggtggctttttactggtgttttttgagattctgggagtttattggtcacgtttcattccttagggaaaccattctggaatttcatcatgaaagacaaacagaaagccatttggttgcttcagatctcttccttgggtcccccactcttactcttgtcaagtgccatgtacatgataagcactggggattcagctgtgagtatgcacatccctacctttaacccaggggatggggcacatggggaaagggaaaaccatcagttataatattgtggtacaccatagcacctacggtattgaaggtcattttctcatacttccttcattttctctttgacatggctcctgaccagacttactggggtgctgctgatggtgacaatgtcccatctggagcagccactgcgaggacatcggctgtagcaggtgttgaagggcatggcaggtgctgcatgctctgtggagccaccaggagctagggcaggtgagggccccactcctaagttggcagggcaggagcacatgctcccgggcacagccatagccacccagcagcagctcagaccccggcatccctgctctctcagtggcctaggaagccccctgcccctgcaggcttgaaagtgcctgctcccactcccgggcctttccccacttctggcacctgctctggggtgagcaaagttgtggccgagcctcggcactgtcgcaacccagctgggtgtgcacgcactcagagtggcactgacacactagccccctgccatctcagtcacctccagactttgggcaccaatgagcatgggagggggctggggcactgagggcagctcagtgtggacctgcaggcacccattgtgacagacagcctgggtgctgcaatggcatgttgatggctgcaggaagcagacagattcctaggtaggaaggggtaggtccctggtgaaacctcttcttcaagccaggaatggcctgaagcctgggggctgggctgccagttccaggtgaagttagtggcccagagtgagaacttcatcggtgaccatttgtccaatcagatggtgccttttccaggcctgcctgtggccacccatggaccaatcagcacacacttcctccattctgagcatataaaaaccccagactcagctaggctcacacactcattgggatgatctgcctgtggaaatgggctacccaccatgggtctcctctccactgagagctggacactagtctggatgacctgcctacagaaaggggctacccagtgcgggtctcctctctgctgagagctggatgctcattggaatgacctgcctgtgtaaaggagctacccactgtgggtctcctctctgttgagagctggacactcattgggacaacctgcctgcataaaggagctgcccactgtgggtctcctctctgttgagaggtggacactcattgagacaacctgcctgtgtaaaggagctacccactgcagagtctcctctccactgagatctggacactcatcagggcaacctgcctgcagaaataagctacccacttcaggtctcctgagagctgttctgttgctcagtgaaaatcctctccaccttgctcaccctccagttgtctgcatacctcattcttcctggacgtgggacaagaacttgggacctgctgaatggtggaactgaaagagctgtaacaaaaacaggctgaaacatacccccctgcccacttctcaccatgttgcaggtgatgagaaggagagaagggctgcagcccttcagggagcccagacctaggggctccccaagccagggcagtgacacctctttggggctctgtggttcctggaatctctaagcttccaggtgccactgcattcccgttgtccagatgcgagtgccctcaatggaagccactcatgttacatctgatccagccgcagcctttcatagagccagcatctgtgctggtgcctcttgctgcctgccccactgcagcagctggcatgcctggctatgtgcagtggccggaccttgcgcttgctcgctcacacacccctcaccactctgtgcctggcttacctttggcaggcatgtgatcctggctggtagcttggctgagcaaagcctgcttggccaagtgggtggaataagcccaggaggcctaaacaaaacttgggcaaaggtgtcactggcctcagaggtttctggctagaaaaacgataccttaaggatcctatgacactgccatggcctgctgtgcttctgttccaggggcatatacagattccagtgatctgtggcaccacagaaagcctactttccacggtgtatatgtgccacattttctttatccagtctaccgctgatggacatttaggctgatttcctgtctttgctattgtgaatacgatgcagctataaaaaagaatgagatcttatccttcggaggacatagatgagctggaggccattatctttaggaaactaacacaggcacagaaaaccaaataccacatgttctcacatagaagtgggagctaaatggtgagaacacatggatgcaaagagggaaacaacagacattggggcctcctggagtgtggagggtgggaggagggagaggagcaggaaaaataactactgggcactaggcttagcacctgggtaacaaaatgattggtaaaacaaacccttgtgactcaagtttatctatataacaaacctgcacatctacccctgaacctaaaataaaagttaaggaaaaaaaaagaaggctgggcacggtggctcatgcctataatcccagcactttgggaggctggggcaggcagatcacttgaggccaggagttcaagaccagcctggccaaatgatgaaccccccccgccatctctaccaaaaatacaaaaattagccagctgtggtggtagatgcctgcaattccagctacttgggtggctgaggcagaagaatcgcttgaacccaggaggcagaggttgcagtgagctgagattgtgccactgcactccagcctgggcaagacagtgagactccatctcaaattaaaaaaaaaaaaagaaagaaaaaagaaagcctactctcttcagtgtccctgtcccatgacagatctttgttataagctcctgagaaggcctccgatgggcagcatgtccggcagtttctccttccctctggccctgtgctgcctcagggacaatggccacatctctgcaagaagctgtggcttgggaagaaagagtaacccttgctgccaattcaagcccctactatgcagcaagatgttggccaggtgctttctgacaaaatactttatgccctcctggcactatgagggaggttttaatacccccacttatcaatgagaacatggagaatttgagtgtttataaacttttcccaagttttcataactactaagtggcataaagataaaattccaaaccaagtttacttaattcaaaggaaataattagaaaaacctaaatctagactggactgtgaatgatgcctgtgatctaggtttacatacaaatggaattaaagacattatacattttcctttttctgtttttgtttttgtttttgttttcagacggagtttcacttttgttgcccaggctggagtgcaatggcgcagtctcggctcaccgcaacctccacctcccgggttcaagtgattctcccaggttcaagtgattctcccaggttcaagtgattctcctatctcagcctcacgagtagctgagattacaggcacatgccaccacaccggctaatttttgtatttttagtagagatggggtttcatcatgttggtcaggctggtttcgaactcctgacctcaggtgatccacccgcctcggcctcccaaagtgctgagattagaggcatgaaccactgagcccagaacattttcctttttctacaaatatgggaacaatcctcttatttcacgcacaccttggtgacactctcaggaggcgacctagagaacctactggcttaaggggatagaaagtagggacagtcctctgggggcaggtaccctcattctactccatgtagtgacaaggtctccttgacatgtcatttcccaagaattcgcatgccacacacattcgcatattcccacgcctacctgttgcacagaagactagcgttagctttcactgctgggagggttgcctttgaaacattttccccaaagtgacctctagcaaagtcattcgaatctcctgtcttgggttcttgtcactctgctccaggacgggggaacggccaaaatttactgcactgaatcctgaccacctgggaaagaagaagaaaatacagccttctttaacaccccaggctaattaaaaaggaattgccatttggacctgggggaaataagttgaaggggaggtgattggtttttaggtaaactctgtacttaaaacacaatccttcactccctctactttttctttagatgaaaaaggcatgatttcatcttgccagatatttgaggatattcagatcaggtgagtcaaagccatttgcaaatgttattatctcttgtataaaagtaggacaaaatgagagtatcgtcttcaaatctgcaaatgaacccaggtcacccagatcttcagcagaaatcaataaacccataaacccgtgactgctcatgacaatcagtttcttttttgttttaaaactggcagtggctttcactctctttaaagctttagtcctgcactggacttttttcctgatacttcagagatcatcctgggaaataaacctgccatgccttacctacgggcaaggagtcagaccccggattctgacttcctgagaatgatggaaatttggatccttgctgctcttcatggatcttatcctgcctgcacgcagcaagacaatgatcaaattttcaggtggaactagagctccaaggagtctggcggctgggaaagggatgcatcccactggccccaaccctattccaactcctttcctggctctaactaatgcccaggttctgggatttgcaacacatacctcaccctgtggccccccagcctctcgggatgcccctatcttttggcctggcctgacctggcctgacctggcctggttcttctctactactttgggatatttacgaagttttccattcttacaagtctagcgctgctgcagatcgtctggctctctggctacagctcgagaaatgttctcacccacccacacaactgctgggtgacctgaatgcacccaagttcaggtaacatgacagagatggagagacaattagttagctgcaggcctatattaatcagtctctccaaatgcagtcaaggcacagagccaaggggagttagccctttttgattgtttgcatctgaattaaagtagtcgctcctttcatcaatagcaattaatatttcctgagtgcttcccagtagcatggcattgcattaagtcttcctagggcttttcacaacatagaggatgtgaaatttctggtctcgatgagcatataataataagcaagacatgacaattaattagcaaatatttacagagtgtgtatttagcctagccatttcgctggaagcttatacaccacaactcaataatcatagaagggaccctcaaataggtggaggctgtctccaaagccctgagcttcacaaaggcgtgggagagtttgctctcacactctggccccaggcaccgccaatggtttccaaccataagcagcaccttcctctcagggagtgcctggaaatgtatggcagcatttgttatctgccttaggctacaaactggcatttactgtgtgcagtacagggatgctgatgttcgacaatgtgccagacagtccttcacaaccgagaactttcccacgcaaaatgcctgtagaactcctgttgaaagctgacagagtaaaagctatgaaaatattcagaggattgaggagtcctctggcgattttcctctcccagagtttgagaaatcctcttttggaaggggaatgacgtttggaggggtgagggccaggttagcccaaactctccaggagcctgactgcttcaggcatcagagagtaagcctcagtggtctgttctgctaacaagtccagaagatcatatttttcactgttatggctgagttacctcttttggaagaagttaagcaagattctcagtttagaatattatttggtccttgttttcaactcaacagtcacatcacagtgtgtctttcagggtaatgtttcttaataattgcgaccaattaaaaaaaggaaacaaggaacatgaagtataaacggactagcgccctgtagtaaaatgttcatcggagaccccatagccacctgagccccaagcttcccacgatggtctgtgttatggccgagctgcccgcagatttgcagcaagaggccagtgaggggcagcctgaaaccacagaaagcagtggaacaggtcgggcgcggtggctcatgcctgtaatcccagcactttgggaggccacggtgggcagatcacctgacgtcaggggttcgagaccagcctggcccacatggtaaaacctggtctctactaaaaaaaaaaaaaaaaaaaaaaaaaaattagcggaatgctgtgatgggcgcctgtagtcccagctcctcgggaggctgaggcaggagaatcacttcgacctgggaggtggagcttgcagtgagccaagatcgcaccgctgaaccagcctgggtgacagagcaagactctgtctcaaaaaaaaaaaaaaaagaagtggaacaagctgtggccaacccggggcaggcattctgagagagtagcagggacggaaaggagaatgacacccagcagaagcagaatgtggacgagcaagcctgaatctgcaagagggggcagggcatgtggggtaaggcaccagcgttccaacccacttgcagcaatgctctttggaaccagactgaagcgtggccttggagagcggcatctggctctgaggaagccactgacgccttcgggaaggtgagccgtcttcgttcactcacaagaacaattaaggcacaatttcttttttaattaattaattaataattttgagacagggtctcactctgtcacccatgctggactacagtggtgccatcctggcttactccagcctcaacctcctggctcaagtgatcctcctgcctcagcctctcgaatagctggaactgcaagcatgcatcatgacagtggctaattttaaatttttttgtagagagcgagtttccttatgttgcctaggctggcctcaaattcctgggctcaagtgatcctcccaccttggcttctcaaagtgtttggattacaagtgtgagccatcacgcctggcctcaggggtttcctttatcacttattaccacttctattttctaagagatccttttgtacatacagcctaagacagcatcagtcctttttcgcagtggtgatgttatgggctcatatgtaccctaagtaattactcactattactccttcttcgaaagaaggaggaaactacattgctgtttcttaaacagcagccttccctgttagatatctgtggaatattatttctccccaggtgcattaccttacattaacctatacacttatgctaggattacattatgctaaatcaaaagtgcattttttatataaaatatttccaacttaccatgggtttacctggatgtaatctcatggtaagtggaggagctactgaatgcgtattgcttttgcaccactgtaaagctgaaactcgtaagtcaaaccatagtaaatcagggactatctgtgttaaatctaatcttgttcacttcatttcctcactaaatttgccagatcaaactacaatttaatccctgttcttctgtctccctccatctctttcttccttcctccttccttcccttccttcctttctttttctttgtcttttctaatttagtagtacaaatcattttcctctttctcgttagtagataaattgtggtggatagagtgtaaacagtgttacactctatacctcccccttccaagagcattaataatcagtgcttactgttgtcaatctgattgtcaacagtttgcatttgtcatgagggttggcagtaatggctgtggatttggctttactggaggggaattagttgtggagtcctgataagataagtaagcaacaaagaggaagggaccccaggtggagaagcaccctagctggggaagaacaatgaacaattgttctaagaaacagctaatcacaactcctgggtacaatgatctctttctatgggcacaacgacctctttctgcaggtagcccctccagtgcgaccctataaaacttccctccagcctctgcctctttgcaggcagccccttctctgccgtgctgcctgttgctttcttgcaacatattttcatactttctctaataaatctgcctttctttacctacaacggtcttggtaaattccttcaccacccttgccactggccccagctagtcccgcctgtgacattagtgtcatctattgaactcttaactgttgaagtaattgttttcctttgcagattgacctggctttcctgctcatagttggctattggacagtcagcaaccttgcacttccttttctctgtaacgtaggcattgataggaggggactcgtatccaatcatacttgcatgtgcacactacactcttatcccaccgttacttctccaggctacaccatgatggcagctgggaagagcagcgctccatggttggccacttgattctcggtcaagactcctgccttctagtcccacttagttacagctttggctggcgcaggacgcccagcctctctctatcttggtgttctctgtctgtaagatggagagcacctcacaagatgtggggtgtgtgggaacaagccaacatctggggtatttttaagaggctgggattttaaatagaaataaataaataaggcttcaaaagtcaaatcctaaaaaagatcataacaagaagagatcacctgtataactgggattgcagggcttgaagcagagaacacaggattcagtaagttggctctcagttgtatctttgaggtatgactgggtcctcatgcagctcaaaagttggggaactaggtgtgggtccatacacgcgagtgcagccagcaccatctctagcaccttttagtttcacatcctcccatattgcacggatgcatatgactttggaagagatgctgggttctagggataatcccagaatcaggtaagtctgggctacactgagtatccaagttcatttttcaatcattcatgtcagagaaactgatgaaactctgtcattttcaaaacaggaagtgacttccccaggatcacacagttacaacacttctaggtccagaccacacgccagagtgcaattctgtgtggtggttaggagcacaggcttttgatctgacagatctgggctttagaacccttggaaagcaagcagcacatctgtcattatttgcagtctacctgggaaacccaagaaaatcggtcaaaaatttgaccaatttactagtcttgtcttcaggtgaatattgtaaaataataatgattcctaaattgatattttaggttgaattctagagtcggaacacataataacaaatccaattttgtaaatgagggcagatgtgtactgaaacatatttaaatacatattatatattaaacacatgtgcacacataggatgtgatacttgcacaagagtgaacagacaaaccaatggaaggaagggtgaattattaaataaatagtgatacaaaaaaaattgaaggcccatttttttccaggtaaagtaaggcagtaaatgtaaaaaaaaaaaaaggtcacaataagaaaactagggggaaaaaatagctaaatacttatatgacctatggctgggaaagaactttgaaaacattgaaagtacaaagaaaaagataatttgaccacataaaaatgtaaaacgtaggcacataaaaaataatttaaaacacaataagctagaaaatgacagacaaggagttaatgtttcttctttcatttggcaaatatttctttttttccttttttttttttttttttttttttgagacagagtctcgctctgtcacccaggttggagtgcagtggcagtggcgtgatctcggctcactgcaacctccgcctgccaggttcaagcaattctcctgcctcagcctcccgagtaactgggactacaggcaagtgccaccatgccgagctaattttttgtatttttagtggagaaggggtttcaccatgctggccaggtcggtctcaaactcctgacctcctgatccgcctgccttggcctccaaaagtgctgggatcacaggcgtgagccactgtgcctggcctcggcaaatatttcttgagcacctactatatgccaggtacttgctatgtgctgggtgtgcaacagcagacaatataggcaaaagcacctgccctgagggagtagacagtggacaagttgttaagaggggcagcaaaccccagcaagaaaatggacagagcatatgagcagacaattcacctaagagaaaaactgagcacataatcaacccctgtgtggtgcttccccaagtctggccttaattctgcaatcggaacctagatcctgtatcaactgcccagctcccatttggaagcccagctccctcctattcactgcatcagacctttgccaacactggcttccctgtccatactcttcagccaggccttgccatccctgccacccatctgggattccaggctccctggaatggtttgggatcccggctcctccatgtaagacctgcatgaccttgggcaggtcacttaccctctctgtgcctctgtttcctcacctatggattgtcaattaaagtagtacccctctcttaggggtgaggaccaaagtcctcaggacagcacctgggcagagaggcagctctcaataaacagccgtaattatggctctcctttcaaggtggcccagagccgggtctaccgaggggcagctgtgctgggactggaggaaaaacccactccccacaggccagcgggagagctgcctcggtgcaggactggccctgcgtcaaaggtttacagcaactgccctcaccctcatggcagtcaatctctcctctgagccgactccgggggcgcaaggctggggagaactcaggatcaggaaactctcacttctcgttgttcttatggacatgttgtgggtctttatttgtgacatccaaacgcactgcattgcaggacttcccgctgacgcttcatgagctcacctggtatggttcaccaagtcctaataaactcctacctggcctgtctcttgagccaatgcgaagcaatggaaaaagaccggaaaaaaggtctccttgaacccccaaataattaatgaaaactaagaaatcttgctagcattcctcccctgatcttgtctaaaacaagccctaccctataacatgtttattcttctgcctgggcttcttcaggtatccccccggggaaatgctacaatcctggggttgtatttcaacgtggctcagtcctgccttggcagtggtacaagatagcaaaactactgttctccaaggtaagagggagatttagggttcgtattccaagtggctgatgtgaaatttcagggtctcttggattcttggcttgggagcaaggccgtgaataactaagactttcaaaatgtctttattctccctgctcccttacaaagcaccttaggaaggagaaagtgccacatggagaattccatagtggaactctaatgctgtcctcgttcacaaaaccaagatatatttcaatacaacaatacaaacatagctcttggccataaagatggaattttcaaaagcatagacgatgctcaaatttttattttcaaatttgaaagttccttttcctaacttcgaccctccagatttgcatgtaggaatattatagttcatcaaaaattcatattccagtacattaatacagtggtgaaacataggagagagaacatgtatatagcatgagtatgcaaattaataggcatgcagctttgaaaaggagatcctgttagagatttaattttaactgtagcagcacctggtttcacctttgtttttccttaacccatgttctcttttataatccacaattaaataaagcatttacataaggatatttttacctggcaaaaaaaatagctagagaattactggctgaataaaatctcccaacgataagcaacaggccagttacataaatgaatgaacaggcagtataggcaacaggaccagtagagcctgtaaactgaagataagcttcggggggcagcagccactcagcccgcacctgccaatttttgccattcaggctgggggtgcagtgacgcaagatcttccgatttttcaagagaagtcagacatcctgatgtttatgagaaatgtccaaaatttttaatttggaaatccatgcaaaaatcaaaacaaaacatggtacaaacaaacaaacacatctctagtctggtaacatattttatgagttcccaggtagcaagctctgtagtaaggggcaggtgtttgattttgttttgtttgtttttacttattttcttttattttttggagacggagtctcactctgtcgcccaggctggagtgcagtagtgcgatttcggctcactgcaacctccacctcccaggttcaagcaattttcctgccccagcctcccgagtagctgggattgcaagcacccagctactttttttgtatttttagtagagatggagtttcaccatgttggccaggctggtctcaaactcctgacctcaagtgatccatccccgctcagcctcccaaagtgctgggattacaggtgtgagccagtgcgcccggcctgttttcagttattttgaatgctatttgagtttcatagcaaaaggaaaattctcataaaatgttgaatttgaagatacaaatgtatttaagaaaataacattgatagcttaaagtggagatttttatctaaatgagaactatcactggaaactgtgatgacacatagaggaagtatagaatgttctagtaccttctgagtcaggctagctgcatgggcaggctagcacagtgtcttgattgagggtttttcatgatgccatatcacagacctatgagaagatgggtttcaaaggacaagtcataggtaacctgtaaacaagtagttaaatccactttggcactgaaagttccttgaagcacaggttaaatttgttctgggtaaattgcttcagattgaagaagctgacacttcccacttccttcctgtttctgtttccactttctgtgtcctaactttcttcctccagatcagttagttctttcctcctcctggactggtttcatcatatctatcatacagacaattcttcttgattaattaagataatcgttttggtttggttctgaaatgcattatcccaccttcttagttatttacaatattttccttaggctaatgttaaaattggtctgaggaaactatgccaccccgttctcccacccagccatgcctttctcctgctacagaaactcccatgcacagagacaaggacagccactatctggaagtgccgggagccatgttgggatttatgacaggtgctacacctattctgggggctgacgatggaatgcacttctggtctgctctgccttaatttgtttttctagacgtgttcaacagctggacaagatccctatgatcaattaggtgctgtgcccttgaaacaaacactcacacaaacagctggagaatccctgcagtctcacactccccatggcagtccctaagaagctcggctttcccatgaccagacatctagaaacagaatgagtgaggcaggggaggcgtacggtataagaagtggaaggaagattctaaatgtaaagaaaagagagaccccaaggtcaggcactgtatttggtcctggagatacaaagatccatatagtgagatatcttactaagatcataaaataaataagatgtgggatcttagagtctaggaaatggaacagacaagtaactcaataactaccaatttagtataataatagtaatagaatgtacaggcctcagaggatgtgcagagaagcaagagtgagaaaccctatctgagggcataaggacaggttttgttgttgttgttgttgttgggttttttttttttgagacggagtctcgctctgtcgccaggctggagtgcagtggcgccatctcggctcactgcaacctctgcctcccgagttcaagtgaatctcctgcctcagccttcccagtagctgggacaaggacaggttttaaagagaatttagccacagagttttgagagaagagtcgactagaaagattcagcggggcaggatgctctgggcgcgatggagatgggcatatacaacctaataaagaagacaggaacgaccgcctcctgccctctaataaagacatgcggcctgtttccagccataacatataggtgtgtctgcttagtggacactgaaatgaagagcaggctcagagccaagcatgttagactggggcgttcaggaaagagcagagaagtttgctgctcagtaaagaggggagagggggaccccaggccgctgtgaaggctctggaggaggcagaacttgcaggcgcccttgggttctccgagggggcttggcagccacggggaccagagaggcgtgagacatgagggtagttagggtaattagggcagggccccctgaaggagagccttccagcccaggctgcctcgggaggatgcactttaccatccgaaccaagtggggaagaggaagagaggcgatcagtcgctgcaacaaaccaagtgcttcaggtgggaggattacttgaggccaggagtttgagaccagcctggccaacatagcgagaccctgtctctctttttttcaaaaaggcaaaatttaaattaaaaaaaaagaaagaaagaaagaaaaagaggaagtgctggccggcacagcagaaaccttggggcaacagtgaccacgtgggcagaggctgcgagtgtcagcaaaagaggacaggccgagaactgctggtttgcagacccctaactggcccccgctggcccccgcagctgactcagcgcaccctaaactcggaggaagtgccagacggccaggtcctgggcagcccgggcgctcgctccgctccaggtctcccgagcaggggtgcaggcccgagcacccgcacgtggcgtgcgcccctagctcctcccggggcggcagctcaccagcccccgccttagtggctggcttccacccagccaaagccaggaaatgtctgtccttaagcctcgatttgttaattatttaagcactctgtgtgtgtgtgagagagagagcgtgtgtgtttaatttcctttatttaaaaagcacgccgagcccactgggaccgcggtgctgaagaggccgccgggcccgggagagactgcattctgagaaccagcccgcaagccccgaagtcggagatcgcaaggtcctagcggcaacagagcctcctagcgatggcagcgagcctcgccccgcctgcggtgaacccgcccccgctcaccccgccacaggtccggcgtctcccgggtccgccgcggccgcgggcagagctaggagggcttctcagcccgcggggcaaccctgctgcggctccatccagaacctcccgctgccaggcgccgggaccggggacgctggcccccggattcaaacctatcatggtgcatgataacacataacataacataacataacataacataacataacataacataacataacataacataacataacatcacaacaccacatcacaacacaacacaacacaacacaacacaacacaacacaacacaacataacactgagcgtttagattcagcatgtactctgggccaggctcagctctaagctggtgcggatcaccacgatgacctctagagtctcctctgaggtgggttctactgttagcccatctaacagatgaggaaatgcagatagaagtggtggaggaagtggcccaagctcaggcggtggctaagtgactccagggcaagcccctcgccccctgtgctggaggaagcccgcgcccaggctctgtcgctgagcagggcacgccttccacgcagcacccaaatgcatcgaacactgtgcacgcgcacgagaataagaaaccgtgacaaaaatacgggtgcatcaatgtagagtaatgagaaggcaaagctgtttgtaagcacgatacaaaacccagaaaacatcaggggaaaaaatggaaaagcccgaccaaatacaaaattttaaacctaggttggctataaaataatataccactgaagaactggggcccggcatggtggctcgggcctgtaatcctagcactttgagaggccacagcggcctcccaaaggatcgcctgaggccaggaattcaagaccagcccggacaacacagtgcgatcccgtctctatttatttaaaaaaaataaaagaggaagtactcgcggtacagcacagaggattgcttgagcccaggaattggagaccagtttgggtaacatagcaagtcctcgtctctactaaacaacaacaacaaaaattactcaggcacgatggtgcacatctgtattcccagctactctggagacaggaggatggcctgagcccaggagacagaggctgcagtgagccgagatcgtgcaactgcattccagcctgggcaacagactgagactccgtctccaaaaaaacaaaaccaaaccaaaactgaagaactgggaaaatattcatgatacttattaggaatgaatggctaagtttactaatatccccaaaactcttaatgacaaaagatgtaaacacacatttcagagaaggaactaaaaatggaggataagcaaattgaaaaggtgctcaatttccttccttccttccttccttccttccttccttccttccttccttccttccagacggattctcactcttttgcccaatggcacaatcttggctcactgcaacctccacctcccaggttcaagcgattctcgtgcctcaacctcccaagcagctgagattacaggcatgtgccaccactctaggcaaatgtgtgtatttttagtagagatgcgatttcctcatgttggccaggctggtctcgaactcctggcctcaagtgatccacccaccttggcctcgcaaagtgctgggattacaggcgtgagccaccgtgaccggccaggagggcgtttttcacctgtaacgtttgcaactgtgagttcacatcaattgccccattttcagttctgcaccggagacttcaatctagttttcttgttttccataattataactgttctctctagtagtgagaaactcggctcccgtcactctcaatatatttagttacggagtcctccccctccatgtatccagtctcccattccctctgccccactatcctactgcttggacttgggtacccttctctggctgctgcctccactgcccctacacagatgccccctctaaccatgtagattctgccaccctactgtgtcctctctaccccgcccccacatgtacacctacctcgacgttgttggctgtacattccctgtgggtcttcccttccatgcaggtgacctccctgcttggcccctccgttaattcagacattaaagataaatgcggccgggcgcagtagctcaagcctgtaatcccagcactttgggaggccgaggtgggctgatcatgaggtcaggagttcaagaccagcctggtcaacataatgaaaccccgtctctactaaaaatacaaaaattagccaggcacggtggcaggcacctgtagtcccagctacttgggatgctgaggcaggaaaatcgcttgaacccgggaggcagaggtcacagtgaggtgagatcatgccactgcactccagcctgggcaacagggtgagatcctgtctcaaaaaataaaataaaataaataaaataaagataaatccacttgtgtggaatgattggctcaaaggccatacctctttgaatacacattgccaaattgccttcctaagtgtttgtgccaattgatcctgcactgagaatcgcatctgagtgcctgtttaacgacacctttgctggcattggatattatctatatttttccagtccctttttcttttggtttctttcataagggctgtgcccaggacagaacgaattccagagctctttatggagccatctcatccagccgcctgactcacctacgttcatacctcagccatctgattcgttttgatcaccagttttgatctgattaactggtgagctgcagagtactaagccattggtatagttaccacatttctttaatgagctcatgctccccccattcaaaaagtagtgactgagcagcagtatgatgtgctgggttttataggagtttgcaaagatgtgtaagttacagtctctggccctcaatgctcttgtattcttgaaaagggcagatattcagatgatattatgaatacagcggtcatgtgataagaactccaacataatctggggttcaggttatgcacctggaaagtggtgtgtccaaaatcttccagtgccaatattcagagtgattccacagttacacgccaccaccctgtaaactcacctccctctccttcccaacacaagccctgtgcccccatcagactagtctcctggcctccaaatgcaaaaatacactgtgtttactactgatggcatatcttatcagaacccctcccactcctcagacagctgcatacatacgttctctcatttaactcacacagcaactctgttgaggcagttattttaatcttccctccttagatactgacactgacttcaaagatggtcttgccaaaggtcttaaaaatggggcagaaagttgaacctagggatgtcagaccccaaattgtgtgggcatccttcccttgccacgggcagcttcattgccagggtgtccttccccatgtcctgctcttcttcccgcagggaccaccctccctctctgcccagtgcctgcctcttggttttatgtaggttttatccatccatcaaggtccagctgaaaagcccacaaaatttcccaaatcctcccggctgagatttctccgggaagctgaatcacagtctttggtagacttttcacaaggtcatctggcaaggttttgatggagatagatgggatctccaaaggaataattcctgggccccaagctgacttctagtgacatccccagagtcacgtgttcctctgggtggaaactcttttaaaacaaatgttcaccttattcactgggcttgataaattctccctgggtgaaggccacgtggagcccctggtctgatggggacaggagggactgtgtgtgaaaaggaaattaattcaatgctcgcaaaaggaagattctatcaggaaatatacctaattggtgtaaaaggccactgtggttgttggcactaagccactcaccctgccagcctcagtgcttagtgtatttatgtcctttgtcaccttcctaattggaaggagtcactctactgactcaccatctttctcccctttatggaagagccgtgggaggtagtgtcactcaaggtcaagggctcagaattggtctgggtctgcagtgagatggtgtcattaccctgagagctgcttggcagcgtttggaaggtaaattagtgtcttcagttgaagacttgctgcacagatggccaccttagttggcgtgacatctcacttccttgtctccccctcagaggaaaatgcctgggctggctgggcctcatgactatgaatttccattacttttttttttttttccaagatggagtctcgctctgtcacccaggctggagtgcaatggcgtgatctcagctcactgcaacctctgcctcccaggttcaagcgactctcctgcctcagcctcccgagtagctgggactacaagcacgcgccatcacacccagctaattttttgtatttttagaagagacagggtttcattaagttggccaggttggtcttgaactcctgacctcaggtgttcctcacctgaggaacctgacctcaggtgatccacccacctcggcctcccaaggtacaggaattacaggcatgagccactgcacccggctgaatttccattacttttgaaacacaataaaataactagaaagagaagcttaaaatcagcccagtactaagaatgtacccatgaggacgacagaggcagcaggatgtcgaaactgtgcttgggaagcaggcagctgggcgggcgctcagacacgctgactcaggagctcagtctgcccctcatcgctcttcccttcactcagagaattctcttgcccccaaatgcaagtgtcagactgctgaaaaactccttgaagttcaggcatttcgtctttctaccctcctgtccaccctcctggcagaggcaatgaatcaaatttctaacagcctctctttcctctgcaagcttggccacgtccaaagggaagtcatcttaaagctgggatggagaaagaaaagaaggtataagccatgctcagaaccttctgggctcaactctagtgtgtgttcccacccagccccagcctgagaaggcttagactgagaaaagccaaccagatcatagaaaagccctcggggacagggaccaaggcccttggccctcagcctagcttgagctcccagccaacagccaactctgattttccagccatgtgcaagacccatcctgtaaatggatcctccagcccccagtgcagctgccctggggcccagtcaatgccatgtggagctcatatgagctttccctctgtgtcccagctgcagatctgatgatctgctatttcagtgaagctttgggatggcttgctactccgcaacagataaccgtaacaccagggttccagcattccctgaggcagctcagagggatgctgaccactcagcacgcctcaggaaggggccactggccagcctcgcacaggcaagacgatacaagcctgtgagatggcatccaaacggcaagcccagcgctgaacaccttttacacacctttcatgctttccagccccctctcccactactcctcacccgtatccttggatcttgggaacctgctcagtatttgggagacttgaccacggttgctgtaacttagtaaatataaatggggagtaggagccccagtcaccttttctcccaagtccaagcccattacccccgctgccgtggggccttttgcgggctcccttccacacctagcatgttgctttgtggaaaatggattcacaatgggaacaaggggagtttggggtctaggaggaaatccaagggatgtgattgctgcaggagcccaggcaggaaggagttcaaggagatcaggaccattaatatcacgtagaatagagaggccatgagagaaaagagactaaagcatctagatatgggagaatggacatgagttccaagagcagaagggacagaaactaacttggggtggcttagagtgagtaggagggaggaggtagagccggtgggtgctcgcaggcaagcccatcctaaagcttgtggagaagggaagggaaaaggtatgaagcagacaagggggaggtggagggctagggaagatctctagtttctaggatagtttggtttttaagaatgaagttgctggccaggtgcggtggctcacgcctgtaatcccagcactttgggaggctgaggcgggcggatcacaaggtcaggagtttgagaccagcctggccaacatagtgaaaccccgtctctactaaaaatagaaaaaattagctgggcgtggtggcgggcgcctgtaatcccagctacttgggagactgaggcaggagaatcgcttgaaccggggaggcggaggttgcagtgagccgagattgtgccattgcactccagcctgggcaaagggcgagactttgtctcaaaaaaaaaaaaaaaaaaaaagaatgaagttgctaagcaagtttattcaagagaacagctgagaggaggggctgaccctaaggcctggtccctggaccgtctcctggtccagaatgcaggagctgtccctgagcaaccgtggacatgctgggggctgaagggacccacggggtgcagggagccaagcaaggaaggaagtgcctaatcaaaggactgtgttagcgccttccgtgcccgcgtgcaggaggggctgtggggcagcaagccttcgccaggccacgggcctggaagcaacatgtgcctgcagctgagctctaactcttaactcagatggtcttctacagaccaataaaaatagcattttccaaaaacaggttgattaccccttatctagaatgccttgggcgagaagtgttttgaattttggatgttttttggatttttaaatatttgcatatacataatgagatatcttggggatgggatcaaagtctaattcatttatgtttcatatacaccttatacacatcatctgagggtaattttataaaatattttaaaataattttatgtaggccaggcacgatggctcatacctgtaatcccagaactttgggaggaagaggtgggaggatcacttgtatccaggaggtggaggttgcagtgagccaagatcgcactactgcacttcatcctgggcaacagagcgagactctgtctcaaaaaataaaataaaggccgggcgcggtggctcacgcctgtaatcccagcactctgggaggccgaggtgggcagatcacgaggtcaggagattgagaccatcctggctaacacggtgaaaccccgtctctactaaaaaatataaaaaattagccaggtgtggtggcgggcgcctgtagttccagctactcgggaggctgaggcaggagaatggcgtgaacccaggaggggcagcttgcagtgagccgagatcgcaccactgcagtccagcctgggcgacagagtgagactccatctcaaaaaaataaataaataaataaataaaataaaaataaagggtagcttttggctacccagggcacactgcctatggggtagccctgctcctcaaggggcagttaaaaaaataaaaaggaggccgggcgcggtggctcacgcctgtaatcccagcactttgtgaggccgaggcgggtggatcacgaggtcaggagatcgagaccatcctggctaacgcggtgaaaccccgtctctactaaaaaaacacaaaaaaattagccgggcgtggttgcgggcgcctgtagtcccagctactcgggaggctgaggcaggagaatggcgtgaacccgggaggcggagcttgcagtgagacgagatcgcaccactgcagtccagcctgggcgacagagcgagactcgcaaggacagaaaaccaaacaccgcatgttctcacttataggtgggaattgaacaatgagaacacttggacacaggaagggggacatcacacaccggggactggcgaggggtggggggaggggggagggggagggacagcattaggagatatacctaatgtaaatgaggagttaatgggtgcagcacaccaacatgccacatgtatacatatgtaacaaacctgcacgttgtgcacatgtaccgtagaacttaaagtataataataataaataaaaaagaaaaaaaaaaagatgtgctctattctttctttatgtaaaagagagcaaacctggcctatccacgctgcaagtggttgtggaggggctggcccgcgccccttccgcgcagtctccttccgcgtcacctctgtgaccgctgtgcccagtcgggccccacagaagcggcaagcgacgtcctcaaccgcaatctcggctcctcgggcgccacccagtggcctcggggcggaatcgcgggcgagctcggaggggctcggggtggcggggcgcagcgcggcgcctgtaaaacaaccctttgtcttcagaaggcgcttgtcctgccaaagcaaagcaccgtgctttacagctactggaagagcagtcctgagaaacaaagccccgattttttatagccaccggggaaaccagagcccacttccttcctccaggaccagggctttattgatgcggatcatcttgtttcagggctgacctgctgccatccctccaagagagacaggagaaagattgaagctctctcagggaattcatcaaaggtttttctgttcaggttaccaaactgttacaaagaactctcttatggatctctttctctttcttttcttttctttttctctttcctttctttcttttcgttcttcctttcttttcctcttgctttctctttttctttcttcttgctttctctttttctttcttccttctctttcttgctttctctcttttttctttcttccttctttctttcttctttctcctcttccttctttcctttccttccttcctttctttcttttctttcattctttccttccttcctttcctctttctttctctttcttctttcttcctctcctttttttctttcttttcttctttctcttcttccttctttcccttccttcctctctctctttctctttctttccttcctgcctttttccttccttccctttccttcctttctttttctttctttctttcatttttttctctccctttcttttcttttctttttttttttgagtttttaaataacactgagcgtgatctgcccttccctgcacagctgagaggaagagacttgggggtacgtgatgagtgacacctttagtgcccttctgtgccctcctgtcagggagggaaacagcttctgcctctgggggggagatgccaggaagctcagcacgggaccaaagggggcccaggtgaggagggtgtttggggcggggagccagtaggcaccatgggccctggtcttcttcaggcctcggtgcccaccgtcccccactcccccagacagccatgcatccaggtgctgtgaccaagtgaggcgatacagtgggtgctagaccatgaattcaatttctcctaaaggaattcaggagaaaccatgtcagaataaaggtttcaccaaattcaagaatgaaaactccgaaccaattattagccaaagacgatgatgcagggaaggtggccttcccaagcaggggggttgcgttgaaagttctgctgtgagcgatcaagttacttaaccctctgaggctcaacctcctctgctaaatggggatgtcaatgacacccacttcataagactgttgtgagtttttattgaggtgatatacatttaacggtgatcaattttactcatagacttgagtattaaaaaaagtgccacattcagaatgttcccaaatcatattaaatcagcttgcctgtatggtgagaaattcaatccgttgaatttgaggtgtccttcttgtctctaggatcacatgagagtcgttggtaaccctgtcgtgtccagaaagccagtgctgggcctttagctctagtccatcagggtaatgccaaaccccggcccagcccagtccctaagactgacagccatggagggcagggccaggcctcccagggccccctcccaaccaagccctctgggttacttcctccttcctgagggggctgagtgtgggctggtggggcagggcttgtctttattactagcagaatacacacacacacacgcacacacacggacacacacgcacgcacacatctattccgctgccagccttaggagctgtctccaagactctggcactctgcaccctccacctcttgccctccaagggctctgtcttgtgccctgaaggagagatttcacacaatccccaacatgaggctggagagcccagtacttgggatggcaaaggagaaacaaagacaacagcaagaacgacaacgtggaaaacacagattaattcctcagtgaatcaccctgtaaaaccatagcacatgtacaaggcaaatcctcagtaactgggaattgtcatcgatgtaagaggctggattggggacacataaactattgtcattagtgctgtattattgctgtgctgcggcctactcagctgttccttttgttgtatggacctacctgcccattggtgccctactggtctggatgtaggctctggatagcagagagcagcttgctcagagctcactcaggggacctgcctaagcctttgctatgtgagtttctgctgtgtgtgtgtgtgtgtgtgtgtgtgtgtgtgttttcaatatctacagagataaatcagttcaaacaaactgtgctgtgtaagtgacctgcccttggtgagccctcactgcagatttgatctttcaaccacaggagagagaactgtactccaggggagagaattgcatcgggtcaggaggtctgggctgtccttcagccctcggtggctctgtgctcggcctctgcactgggaccttgacgttcactatcttgggtttttctcctctgatgggagatggggtggaggcaggggatcccaccttccctgcctacctccctgggatcaaaagaggtcacaggatattcagtggacacattctgaaaaacacttgtcagacgaggtaattatatttcagataataacgtgagcagggaaatgccaatgcctgaaattccctacgtcacaaaatagcttcgtgctagcctgatacccaggcgcgacagaaactcagagcccatgcctctttctggcctcaagcttgcattcttccatggggagtgaccgggccaaccatctctgtcatctactcccagcctcctgccacttgccgagagtgggggctgtggaaccatcccttggggcctctcgacctgtctctatcccaccttccttctcttccataccaccccactggcttcctggacctcctgcttggggcagccctggcccctcctcactgatcactgccacaggggagagagggctgagcctcgcagagaaaaagctggcgtttcatgaacgtgtggcatgagctgcatcgtctcatcagtgcttgtacaaccctctgacttggccttttcatttttacagatgaggaaactgaggctcagtaacatgttcagcttatgcccaagttcacacagctgagaagacacagaacaagaccctgcgccttcatccctggaccctatctctgcagtgccagaggggctccgaagcccgggtctccaccccattctctgcctctcctaaagggactgattcccagcttggccacagagtgtgggcaaaacagaactggccccactcagtcacctctgaagagctttcccagcccaagaggaagacacccagctaagcagaccagctgcctgcagaggctttggggagacggtggccccaggaggggttcccattgattctatttcaataagggaaatgtaataagtattttttgtcccaatggtcaaaaaatgacaacaaatttagtttaaagatcttaattgtggtcgggcatggtggcccatgcctgtaatcccagcactttgggaggccgaggcaggcagatcacttgaggtcaggagttcgtgaccagcttagccaacatgttgaaaccatgtctattaaaaatacaaaaaaatagccgggtgtggtggcgtgcatgtgtaatcccagctactcaagaggctgaggcaggagaatcgcttgaacctgggaagcagaggttgcagtgagccgagatcgtgtcactgcactccaccctgggcaacagaacgagactctgtctccaaaaaaaaaaaaaaaaaaaagaaaaccttaattgattatttatttgtgattccagaatcaggcagcccctgtactggaataggttcaaagcactgtggccagacagcacggtggtcaggcagtagcagaggatagaaaatggaagggcagcctagcgctgaatggttgcagctgggcatttgcctaagttgactcagttgaccacccatggttgactgaagctcagctgctgtaatgagtggaggctcagctgttagttacagaagtatgctcctacgttaggttttcagttagtttctgaactaagccaggcggcagtttgttatgtcagggctcgagtgcggaggcatcctcgggccaagtttaggttaatttaacaccactgagagaccgcaagatgacaaagaaaaatccagcattgacaaggcacatctagaaatttcacaatacttcccagcctccgtgactcttgtaaatattaatttaaccctctgggtaaattggtaataaaattctctttgtattaaggcaatggtaaaagttaataggctgtaagccagaataattcctgggtggttttattgcggagcatgtgagtgcctcgaattgtactgtgaggcactgagtttctaggccacactccatgactggaatagcattatcgttgactcatgtggcattcccattattgttatacaacctggtacaaagcaggtgttcaataaacatcattgtaaggccatgtgcagtggctcacccctgtaatccgagcactttgggaggccgaagcgggtggatcacctgaggccaggagttcaagaccagcctggctaagatggtaaaacccagtctctactaaaaatacgggtgtggtggcacgtgcctgtaatcccagctacctgggaggctgaggcaggagaaccacttgaacctgggaggtagaggttgcagtgagccgagattgtgccactgtactccagcctgggcaacacagcgagactctctcaaaaaaaattaaaataaaataaagataaacatcattatagtgagtattgaactcagcacacatagcacaaaacaaaaatctaggggctacagttaatatttttttaatgtccatggttcaggaatggatctagaaacttcttcctttagtgccctaaaacagagatcctagaaaactaagatgctttcgtttgggaagtttcctgatcccttgtagaatcttcctgatagctgaccccagtgctcagaacgataacaaattctgaattttgtacaggaagtgtgtaaaaaaacacattttaccactgacctcaacaaaaataacaaccccagtcaaagatctagtgacaccagaatatctttaaaaaatgcctgtaggccgggcacggtggctcatgcttgtaatcccagcactttgggaggccaaggtgggcggatcacctgaggtcgggagttcaagaccagcctggccaacatggagaaatcctgtctttactaaaaacacaaaattagttgggcgtggtggcaggtgccggctacttgggaggcggaggcaggagaatcccttgaacccgggaggcagaggttgtggtgagccgagatcgcggcattgtataccagcctgggcgacaagagcgaaaagccacctcaaaaaaaaaaaaaaattgcctgctacctggtcactaaacctcaggaatccaaggccccggctcactcggtgctcacagtttgagggtgacatctacctggtctctctaaaagagcaaaacatcattccatagcgtcactatgaacagctggccttcccgtcattctcctcacttcatcccatgatcagtcaagccaggaaggaagaagtcagtaagacactgacgcctttcctgttagacaaccaggaagacccgcgtttagttatcacactgtaaatcaatcctgacaccttctccgtgatcctaggtcttcctgtgatattcactgttttgtttatgtccttttgctttaattcaagaccctgtgaccgcatcgtgcccagctcatgctctgcattagtaaaatagtggccgctgtggcgttggggtgtttttcttgccctcgagtttagctcaagtactggggctttcatgtgcagacacaccgtgatgggtgagcaaggatctggaggagcctggagggtctggggctggtgggtggttctggaaactaatgactctagtgccccaccattcacctgactccgccactgtctctatctctttttcttgtgatgcttctcagttctcctgcccccaggcagccgctgtactgtcatctgcttgtcattgtctatgtctcctgcccaagggaagcctcatcctgcagtgatccctcgtagccctcctgcctcatcgcctttcctgcgcagcctctcagcaaagtcaggttccaccgctgccagcctgcctctgcgtatttcagagaggtgacctggtggacaaggcagagctctccaggtcaggcccctgcagggccgatgacaagcctaccacgtggcccagaataagacaccaggtgccagcagcagcctggttctgcgcaggtgcagctgtgtttcaggagcaggctgagcgcggcaggggctgtgacggacacatccaggacaacagcccggggcacaggagcctttcctctgccctctatttgggtttatgcatccgttcatctggtctacttggggtcagcaaggtcctccgtgttgttgagtctgatggccaatttccaggcctggttctccctgactttgcgcaggcatccgacctgctgtctccctctcctcctggaagaagctcggccccaggacaccacactcgcctgccgccgcctgactctcccggcagcccctttcttggtctccttcactcttctgcccctccctttatcgttccccaagcaagggctacagattccttgattacctcattgatgtcattggtctgatcgctttgaataccatctccacgctgatgactggaatttacacctccatcccaggcctccccctgaactccagctgcagactcccggctgccgactttccactcagttgtctaacgctcatctgaaacctaaagtgcccaaactcctgatattcatttctaagtttattttaatttttgtacattaaaaaatttaggccaggtacagctcatgcctgtaatcccagcgctttgggaggttgaggcaggagggtcacttgagcccaggagttttgaccagcctgggcaatatggcaaaaccctgtctctattaaaaatatatataaattgaggctgggcgcgatggctcacacctgtaatcccagtactttgggaggctgaggcgggcggatcacctgaggtcaggagttcgaaaccagcctgaccaacatggtgaaaccccgtctctactaaaaatacagaaattagctgggcatggtggcacgtgtctgtaatcccagctactcaggaggctgaagcaggagaatcgcttgaacctgggaggcagaggctgcagtgagctgagatcgtgccactgcactccaacctgggtgacagagctctgtctcaaaaaaagatatatatatatatacacacacacacacacacacacacacacacacacatatataattatatatatgtataaatttaataaaaatgtttctgtagctaaacatcttggtatgttgcccagtctagtctccaactcctggcctcaagtgatcctcctgccttggcctcccaaagtgttgggattacaggcgtgagccaccacacctggcctgacagccatttctatcaactcctcccgcgatccctcccaaaaaacccctgctcctctgggcttctttgcaaatgataactttattcttcatgttgctcagacaaaatctatatatatgataaaatatcttaagagatatattttatatagtcatcttcaacttctcttttttctctcactcccacttccagtcttcagcaaattctgtcagttccgccttcaaaacgtgtccagaatccaccctcggctaactctctccctggctcccacgatcctcctggctcgtcacctgcttccacctttgcctgctgtggtctcttctcaactcaagccaagcaactccgttcaaatatgattagatcgcggaattccttagctccaaaccctccaatagagcttcctctgttactgaaattgaatccaaggccatacaaggctcgcagacccacagtacctggaccctcgctgcatctctgacccttcttcctcctcctcttggttctcttgccccacttcctccaacaccccagacatgccccaaccttggtggtctttgtccctgagagatatcctcatggttgccccaccatctcctgcaggtctttattcaaatgttgccttgtcttgaggcctttcctggacacctcagctaaaactgccacctctaccccctaaagcccccctcccttccctccttagtttccctgatgagcacagaccactgtctaacaccccacattcttactgatttattgtctgtatccctcagtgaacaaagcctccgggagagcaggcatttgtgtctgttctgttctgtgctgtatccctagcacctagaagagtgcccgacacagaggagttttccatgaatacttctggaattcgcgaacccatggaaatcttcattgccctgttcatcagtctttgcgaggcagctgctgtccgtgtgtgcacgccttctcatggctggttgctagctgtccttcagccaaaacagaacctttccagggtgcagtttgcctagacaatgcattactcacttatgtgttgtcgatcgactgagagagggatttttttttaaacaatttatttatttttagatggaattttgttcttgttgcccaggctgcaccgcaatggcacgatctcggctcactgcaacctctgcctcccgggttcaagcgattctcctgcctcagcctcctgagtagctgggattacaggtacgtgcaccaccacaccttgctaatttttgtatttttagtagagacgaggtttcaccatgttggccaggctggtctcgaactcctgacctcaggtgattcgcgcaccttggccttctgaagtgctgggattagaggcgtgagtcactgcacctagctggatttttttctttttttaattcacaagactttgttactctgttccttcattggtacagtattaaaaaattaagaatattcacttcaccttatagtctcatttgcaactaaagatggatctatatcacatgggcgctataatgttagacaatagaagagtctttgtcagaggcccttggttactcactattaaagtctctaagcttcaagaagttggaatctcagagaagcagggcattcttcgttgagggccagggagggcgtgtatgggcggcttgctgacatctaatttgtaggtctaatcaggaaactgtcggaccacctgtcaaaaagcaactatttctatgtcagtattgttccagccacatgacaatctgatgataatcttcatctggtcatttaaaactatgtcagaatgacatttaattcataatccctgaggtgaaatttagggggaaaaaactttctgtaatttagtttaaaatgtccatatattgaaatgaacagtgttcagtgtttattgcacgaaatgacacttcctcgctttctcttatatacatttgtcatgttatatgttaaagtatgaatgattgtcaggctctagctgaaaagagaggggctgtaacaagtcacctggagtcctgattcctttctccattgatttcagtcaccccacagttcacgatgtctagtccatctggcaggcacaggtgcaactataaaataggaagaggtttttattactttccagtcccgttctaaatggagctggtgactgcagtagcctgtcaacctgctggtgataaaacctttcaaataaaaacttctcttcgacaaagataaagaaaactagattcagagtctaatctccttgcctcttataaccttcttcttcttcttttttttttaagagcctctgtgaacattatttttaaagccaacaatgaaactctacacttccacaatacaacctaggccttcaaaaacacagatgctgctgactttgaatcacggcctcgctcatttccttcagtcctggcaaatgaagcaattcagaggaattgaattgaggcccatctctatccgccctgcattctcctcttccttccaggctgtgctgctgaaggagacagctcaggggagatggcatggatgcatgctggaggatcctgcaaaatcccggcaagctggctatgaggccagcggtgctgaccctctacgccagatgggaaggcagagacacaatctgtttcactccgcaaacatctgggaacaaaatggtctgtccaccagtgcaaaataccacccctaagcagtatttccaattgttctttttatgggctgtctgcacacactcagtgaagccagctcaagtggttattactaatagtccatgctttacaaccacaccagcacacagaaaaagaaagaaggcttttctggttcatttttttttttttttttttttgagacggagtctcactctgtcgcccaggctggagtgcagtggcgcgatctcggctcactgcaagctccgcctcccaggttcaggccattctcctgcctcagcctcctgagtagctgggaccacaggcatccgccaccatgcctggctaatttttttttgtatttttagtagagacggggtttcaccgtggtctcgatcccctgacctcgtgatccgcccgcctcggcctcccaaagtgctgggattacaggcgtgagccaacgcgcctggcctcagttcatttcttgatgtcaaaacaactgtggcaccaacacatctggcaaataccttgctgcgggcacacaaacacgaaaccaatattatttatgatagatgcacacattctaaataaaatactaggccaggtgaggtggctcatgcctgtaatcccagcactttgggaggctgaggagggtggatcacctcaggtcaggagttcgagaccagcctggccaacatggcgaaaccgtgtctctaccaaaaacacaaaaaaagtagccaggcgtggtggtgtatgcctgtaatcccagttactcgggaggctgaggcaggagaatcaattgaactcgggaggtggaggctgcagtgagctgaaatcgcaccactgcactccagcctgggtgacagagccagactgcatctgaataaataaataaataaataaataaataaataactagaaaacatatcttggacaagagcgaaaaatagtgcaaatgggtcctgtcttggtctgttcctgctgctgtaacaaaatagcttgtattgggtaatttataaacaattgaggccctgaactcctggccttaagcgatcctccttcctcagcctcccaaagtgccgggattccaggcatgagccaccatgcctggcctggaagatgttttcgtgacagatgagtttttcaatagaaaacccgccttgtgagtccctcaatccagcccctcccaccctcacccttcaaaataaataagaaaagaaaaagaaagcccccttgccacactatcaacacacttcatcgcaatccggaatgtgctgaacttcagctcctcaccttggcgggtggcctgtccactcccaggaccacaagctggtctctctggtgtggctctcaggccagctgctccggggcttcgtgttctcttgttccatccttttcacatcgcacacaaacacggcctctgctgggctgtggactccctgcaattggcctcagtggaaatccgtgtcctccaatcggcaggaaggggtgggcattcaggaccacagtccgggtttggcctggcagggccacgtcagcaaaagtcacatcaccacggccatgagcacatggtacttgtgctgctgccgagcaccctccctcacaggaaggatgttggtcctcttcttggtcaagttaacgaggcacggccagagcggtgggaggactccatggcctagactagaccacctgggcctacgatgtcagagacatgggagatggtggtgcctgaggcagccccgagggagagcacctgggccctggcttgatgtgggaggggttccacgcttgggactccatgctgtcatctcccggcgaagtggggactctctcctctccataaactgattctccagggaccagattctcagtgactagtgcatgatcctttcctccataatgaagacacctcagcccatacagatccactgtcacattcttcccagactgctttcctcctcctctaccccaccaccaccccggtggccaccagaaaggaatcctccatcacctcttcctcctcctcccctatctcctcctcccccaccacctcttcctcctccttcacttcctccctctcttccttcacctccacctggacctcggccttcaccaaagcctcctcgaccccaccacaaccgccatggtcaccaatgtcccctcagctgctgaagccaccccacagggactaaaacctggcttcatagtgagccctgacttgcgcagttccagaatccacaacgccacaagtctggggctttcgcacgtgggaaagagtggaagacatttttaaacacaagagtactgaggagcaatttatgccaccatgcagtacagtgtgtcttttaaagaatgccgcggtagctatgcaatttgaggagtaaaagcagttatgcaatttgaggagtaactaaatccaataattgctaatgctagtaatgcattttattaaactacataaatacttaataaaacagtagtgctgttggattatccaacaagtagatcaatgaaacaaaatgtattgaatgaaattgagtatgttggccgggcacagtggctcacgcctgtaatcccagcactttgggaggccaaggccggcggatcacctgaggtcgagaggtcgagaccagcctgactaccatggagaatggagaaaccctgtctctactaataacagaaaaattagctgggcgtggtggctcatgcctttaatcccagctactcgggaggtcgaggcacgagaatcgcttgaacccgggaggcggaggttgcagtgagtggagatcgcaccagtacactctagcctaagcaacaagagagaaactctgtctcaaaaaaaggaaaagaaaagaaaattgagaatctaatatgttccaggcagtgggcactacagaacctatgtttgtatgtggttcctgcctgtgaggttacgctatagtggagactgaccctcagtgacactgcagttactaatgattagagtgacagggagttgggggaggtgtgatgggttaattggtgtcccccaaaaagatctgtgcacctgagacctgtgaatgtggcctcatagagagtccttgctgggtgcagtgtctcacacctgtaatcccaatacgtggggaggccaaggatagcttgggcccaggagtttgagaccagcctgggcaacatagcaagactctatctctaaaaaaaaaaaaataagaaaaaaattagctgggcatggtggtgcacacccatagacccagtcacttgggaggctgaggtgggaggatcacggctgcagtgagccatgattatgccactgcactccagcctgggcaacaaagtgagaccctgtctcaaataaaataaaaaagagaaagaaacactgagtgtgcctaagccccttgagtgtgtattctgtcatgcctttccctctagaagataaaatttgatagtagaattgttatagatttccatccttggataaaatacccagagatgtgcctcgtccctctggggccaagcccggaacagaaggcacagcctcccgactctccctagaccagagtttctcagagtatgataaacacagcacctgaaagcatacattaaggtttaaaatccaaggcccttgcccagatttcctgaatcagagtctgctggggtagggcccaggagtatgcattttgaaagactgtctcatgtatttggacacacacttaaatttgaaaaccactgcattcacgcatctatgacaccccttctcagctctaaagcatctgacctacattgcattcttggctctgttcccgcctatcaactgagcctccaactacctatctagaaaatagagaaaaattttatctgccgctaggtacttgtctagcagtcttcgaaatcctgagatcagagggtccagataaaggagcactattatttatccacccttcattttcaagagacagccctcagcattttccttccctatttgtgctggaatttgccaacgttggaaaggcctgggagcctggaagattgttgtttctctctcactccatgtatgtggcaggttaacatgataagtttctttttttttttctttttttttgagacagggtcttgctctgtcacccaggctggagtgcaatggccccgtctcggctcactgcaacctctgcttcccatgttcaagcaattctcctgcctcagcctcccgagtagctgggactacaggtgcgtgccaccacacccggctaatttttgtatgtttaatagagacagggtttcactgtgttggccagactggtctcgaactcctgacctagtgaccacctgcctcggcctcccaaagtgctgggattacaggtgtgagccaccgcgctggctgacatgataagtttcaacggcttcagatgtctctttttttccctttccttgaaataatctgaatcaaatccggagactgccctcaggcccagctgagctctgaggagtctgagctagtcgtctccaaaggactcatagccaatctcggaaaccagttactccacaggaaagcccgtctacctcccagcacctcaggggcccacagcgcaagcaggtgagctggctggacgatcgagttcctgctcagtacatgggattattcgcttaacactccagcagctccacgagctggggttcattattttcatttttgaaacaggaacaatgaggctcagagaagttaggtagcagaaagtcacacgactggtgaagtggcatcgttgtgatttgtggccgatagcatcctgtctgtgacaggaggcacactctggcactgccccaggctccagccaggtcatcaccgtgatgagcactggctcctgccgggcctgcagcctcagggaaggtgctccacaaacatttggtgaaagcatgatacctctacctaggagtggttacctgcccctgaacttgagcttccttctctctcacaggctgcctgaccccagaatgtcctccctgaaactatccatcctgcaagccccactcctctgtcccactatctgatgggaccctatttgtattggaaaccccctccatttccccaccaactgcttggctgtgataccagcggttttccaggcaggtgggttccaaatatttagtttgctggactgaatttccctgtggtccctacaagtgaagatttgtcgtttttcgagggcctgacccatctcagcgtgagggtctttgtcaagggctgggcctattcctcccaccatttgactgtggctaaacatcctaggcccagttacattctcagacaggacaaggtgctggatggctgacacctgtgcagggacttactgcctgtgcagggacagagatcaccaggcttccgagattctgtattcctttcctcctggcaatcccattaaagttattacaagtaataaaatagcactaatcccacaataccaatgatacagaggcgcattcagcaggctaggtatttcaacacatttagagaagatgggaagggtctgaagcgatgcagggaaagctgccctccagagggggcatgtggctgagcagacggctgacctgccgggcacagcgccagaagccccaggtatacacagctcaggtatgacaggggcaggaggtgagaggagagtgaaataatgaaatgcaatggaacatatacatatatatgtatattttattttcttacaaacgtcacacatgcttctgtaaagattcaattactgctggaatgcctaaagtaaaatgagtcatctttgcctgtcaccctccaatagttggaatgtacttccttggcataattatggttaacaatttttttttgtggtgggggacagagtcttgctctgtcacccaggctggagtgcagtggcgcaatctcagctgactgcaacctccaccttccaggttcaagcaattctcctgactcagcctcaagagtagctgggataacaggcacgtgccaccacacctgcctggctaatttttgtatttttttagtagagacagggtttcccatgttgcccaggctggtctcaaactcctggcctcaagtaatccacccacctcagccttctaaagttctgggtttacaggcgtgaaccactgtgcccagcctactgttaacactttttttttatctctatccctgaattttagtttattttttgaaacacatgtaaacacgtgcatttgtagatttttaaaacataaaatgggatcacactatatgttttaaaatgtaggtttcattattattcaggtagggtgaggccaactaatcaggaaacaactgccattaaaaacacagttttggccaggcccggtagcatgtgcctctaatcccagtacttcgggaggccaaggtaggaggatcacttcaggccaggagtttgagacaagcctgggcaacatattgagacttcatatctacaataataaaaatgaaaataattagccaagcatggtggtgcacacctgagtcccagctattcaggaggctgagacaggggaatcacttgagccaggagttggaggctgcagtgagctatgattgtgccactgcactccagcatgggtgacagcgcgacagcctgtctgtctccaaagaaaagagatagtttattactcccatttcccaagaggaagggagacactataccaggcagggccacttggggaggtgccagggtcaatcaggaggcagcaggagtgaggggaaaggctggccaagagcctctattgtggttttcctgggaagaaatgggcaaggcaggctcagcaggacaggcaggtacgggagtgtttagtctgaataacggatgtaggcactaccctagttgcttgtgcctggccctggtgtgattagagcagagagacagtggccaaatctgggagaggtcagtaaaggagggaggtggcagggatgggctctggattcatgaaaatgcaaagtgcactcctaggggagtcatttgctgttgtaggaactagccagccctgggagggttggtttctccaggatcagcgacaccttaagatgccagattagcaagagtacagaaaatttaaaaataaaaataaaaggttaatgtggcatatctctaacttttaagctaaatgatgtgttcaggctgggcacagtggctcacacttgtgatcccaacactttgggaggctggggcgggcagatcgcttgagaccaggagttggagaccagcctggccaacatagtgaaaccccatctctaccaaaatacaaaaattagctgggcatgattgtgtacacttgtaatcccagctactcgggaggctgagacaggagaactgcttgaactcgggaggcagaggtagaggtgagccgagaacacaccactgcactccagcctgggtgacagagcaagactccatctctaagtataaaaaataaataaataagtaatgtatccagaacaagagtacatacataacagcttgttctttttaataacttcatcatatcccataatttggatgttccccatttgaatgtgaattccatgaagggacagttttgtctccttttatccactactataccccagagtctagaatagtgacagatacagggtagatgcttaaaaatatctgtcaaatgaacaaacaaatggcccacaatggactcaaccattgccttatcaacagatatacacattgttattttttatttcagacaacacttcaataaacctatctgtatctacggttgtgcctcagtaaccatggaggattggttctacaatgccccacgtcagataccaaattccctgatataaaatggcatagtatttccatagaacctacacacatcctcttgtacagtttaaatcaactccggactatttataatacctaatgcaatgtaaatgctatataaattactgttatactgttttgttcagggaataatgacaagaaaaaaatctgtatatgttcagttcagacacaatcaccattaaaaaaaaaaaaactccatctgaggttggtagaatccatggatgcagaatccagggatatggagggccaaccctcaatctttatgcactcgaattagttaggactgggcttggagagtaaaagaatgacccaaataattgtggcttagccaagacagattttttaaatatttgcattcatttatttttatttcaatagttttaggggtaccagtggtttttggttacgcggatgaattgtgtagtggtggagtctgagtttttagtgcacccttcccaggaatagtgtacattgtacccaacaggtgattccttattcctcaccccctccccccctccccctcctgtgtcctcagtgtccgtcataccactctgtatgcctttgcagacccatagcttagctcccacttataagcgagaacatctggtacttggttttccattttggagctgcttcacttaggatactggcctctagttccatccaaagtgctgcaaaagacatgatttcactcttttttacggccgagtagtattccatggtatacatataccacattttctgtattcattcattggtcagtgggtccctgggttggtttgatatcattgcaactgtgaattgtgctgcagtaaacatatgcatgcaagtgtcttttgacataatgacttatttttctttgggttgatgcccagtagtgggattgctggattgaatggtaggttggtctacttttagttccttgagaaatctccataccgttttccatagaggttgtactaatttacatccccaccaatagtgtctaagtgttcccttttcaccacatctgtgccaaattctttctttaaaaactttttaataagtgccattctgactggagtaaaatggtatctcactgtggttttcatttgcatttccctgatgattggtgatattgaacatttttttcacgtttgttgccaagatagatatttcactgtcttatgttcaagaagtctggaggaggtcaggtcagaactgatctggagctccctggattcggggctcaagctcctgctaccttgccgtctctgcccttcacagcttccactccgaagtccccacatggcccatcttgctgccagagctccagccagcagcctgtattacaggaggaagaaagaaacaagtcccagggagcattactcctccttttagaggttacttcctggaagctgctacttccaggaagtatattgtattgcctagaacggcagtgcaagatcaaacctaactataacgtgtgctgggaaatgacattattccaggtgaccatttgcccagctcagcatcataggttcctctgttactgaggaaggcagggtggatggatatcagaaaacatcttgctcttatttctgtcagataaatttccagaagtaaaattgctatattgaaaggtacatgcatttaaacatttttaataaacactgatagatactttcaacaaaggcttcagtaattgaatcccagcaacagtgaatgagaggatctatttccctactcactaacatggatgagggcaagactttttttttttgggggggggggcggggggtgggggacggagtcttgctctgttgcccaggctggtgtgcggtggctcaacctcagctcactgcaacctctgcttcccaggttcgagcaattctcctgactcagcctcctgagtagctggaattacaggtgcttgccaccataccaggctaatttttgcatttttttagtagacatggagtttcaccatgttggccaggctggtctcaaactcttgacctcaggtgatccacccgccttatcctcccaaagtgctgggattacaggtgtgagccaccatgcctggctgagatgcaggcaaaactttttttttttttttttttttttttagacagagttttgctctgtcacccaggctggagtgcagttgcgcgatctcagctcactgcaagctccgcctcccaggttcacgccattctcctgcctcagcctccccagaagctgggactacaggcacccgccaccacaccaggctaattttttgtatttttagtagagacagggtttcactgtgttagccaggatggtctcgatctcctgacctcgtgatccgcctgcctcggcctcccaaagtgctgggattacaggtgtgagccaccacacccagcctgcaggcaaaacttttaaagcttgataatctgataagcaaaagaagttatcccactgttgttttggtttgtgtttacgtgattactagtaaagcttaacatcttttcacatatttatttgccattttctagtcctcttctatgacttgctttttttttttttttatttttaagacagggtctcactctgtcacccaggctggaatgcagtggtgtgatcttggctcactgcaacctccgcctcccgggttcaagcgattctcctgcatcagcctcccgagtagctgggattacaggcacccaccaccacgcctggctaatttttgtatttttagtagagacagggtttcgccatgttggtcaggctggtctcgaactcctgaccccaggtgatctgccctcctcggcctcccaaagtgctgggattaaagacgtgagccaccgcgcccagccaaaacgtagttttaaaatcctggctatacagaatgtcaatgagaaatcctttggttgcaagtggcagaaatccacccaaaactagctttaacaaaaaaggagttcactggtgtgagaaagaaaagtaactcaaagcaatcctacgcaaaagatgcaaaatgtatcaggcccagaaaaattagctgggcatgatggtgcacacctgtaatcccagctactcgggaggctgagacaggagaattgcttgaactcaggaggcagaggtagaggtgagccgagaacacgccactgcactccagcctgggtgacagagcaagactccatctctgagtataaaaataaataaataagtaatgtatccagaacaagagtacatacacaacggcttgttctttttaataacttcatcatatcccataataataaaaaaaagttattacaagttatataatgtgaccctcacccatcatcttcttgttcctagaatttgtgatacaaagaacaatgtgtagcgaatcagtagcttattttcatgttattttatgaaccaatgtaagaactgccccttctttttttctttaaaaacttactggcaattgctgctaatcagagcataaattcaaggcaactgcaatctgtgtctcccaggttgcagtcctcaaatttggctcaaataaactctctacttatattaattttgcctcaatttctttctttaggtcaataggatcattaatgatactatctaaaacagtactgccctaatgtgttgcttttttctgtgacggagttttgctcttgtcacgcaggctggagtgcagtggcgcgatctcgggtcactgcaacctccgcctcccagttcaagcgattctccccgcctcagcttcccaagtagctgggattacaggagtccgccaccataaaaatttttgtatttttagtagagacggggttttcgccatgttggtcagcctggtctcgaaccactgacctcagatgatccacctgtctcggcctcccaaagtgctgggattacaggtgtgagccgctgcgcccggcccctaatgtgttcttattctgttcctttctccttaatagaacgtatcactaccagaatgatctataggtctacatgtccatccatgcgtgcatccacccatccatgtaccccacccatccacccacccacctatcactatgtcttgatgttttcttcaccagagcttcacaaggaccgagacttgttcactgctgaatcccggtgcctgcacagagcagatgctgaggactgaccctcgctctctccatttctgggttctggagctacctgctccttcacgattgcaatccatgctctgcattctatgcatccaaaggatacacacattcttttcctggttgctccagcaaaagtctcacaattggctttcagtggccaggcctgggtgacgtgtccgctggatccagtgattggggccagccccatacagaccacagggactgccagagggaaaggagcagaatcctggggaaatcaggaactgttatcagacgaagggggacaagaacacaaatccattctctttggtcagcctgcttcaaccatttaggaagaggtcaaggaaatgtatagacacagacacactgagggctgtaagaattcacatgtgacaaacgttaacggtgaaacaaacaggagaaaagcacaaccactcgggccacacccttcaccaaggatttcttctttcgcaaatgttctaggtgtttgttttctttctcactgtgatctcctaagtccagctcttgtcaatacacattccttaatctaataaaaatggtttattattaatagtagcagcatttatcaaacatccacaaaatgctaggcaagatgctgagatatttataaggattatctcatttttaaatttattttttatatttattttgagacagggtctcactctgtcgcccaggctggagtacagtggtgcaatcaagatgcactgcagcctcgaccacctgggctcaagcgatcctctcacctcagcctctcgagtagctgggactacaggcgtatgccacaacacctggccagtttttggattatctcgttttatcctcacaacaatcctaagaggtagtcaccactgttgtcccattttacagatgaagtaagcaaggctcagaaaggttaagtaactcccttgaggtcaaacagctggcatggtgagaaggagatcctcgtaggcttggaagcttttctccatgggcagggcagagcaggcagagcagggctggcttgactgtgggacagcagagagaagggactcttaagacatagggctgggtagggtctgcaccaagaaggacggctttctcagccccccaggagcaggggtttaccggccagaggtttactggcctcaggggagctcagggcctggtcagcagactcgaatgcaatcccttaggaatgcatagcgccccccactgcctctctcctcccttctgaatccagaactgtgagaacgaccaggagaaatggactgagccccaggcctgcactttggagaggccgccatgggtgtgatttcctttgcactgtttgggcctctggcacttcctgccaggcaggagatttcttgagacttcaaaggcggcacacaagaggagtgttaagcagattgagcactaataaagaactaacgcctagaacaatcacagcttccctgtgattcctgagagtgaggaaagcacaaagaagaaatgaaagtctctcgctaaccctgggagaaactaaaacatccaggagcagattctatactcagtaatgtgacagagttcacaaaaaggttatattcacactcgaagctactgaggctcatgctcagcttcatcgagagtggtatcaccatacccagaaaaaaatggcctcctatggaaaaagctaacctaatatcatgcatattattctggaacaaaataagtagaatgatataccttatatttctacagtgcttttactttttaagaattttaataccacagcagccaacattatcttgttgctttctcacattcctttataaaaattttctttagaatgttcaaaatcacattcttgcttccagaaagtcgtaagaataaaattgcatttctctctctctttttcttttcttttctttttttttttttgagacagcctcactcagttgcccaggctggagtgcaatggtaccatctcggctcactgcaacctccacctcccgggttcaagtgattctcctgcctcagcctcccaagtagctgggattacacgcgcacgcaccaccgcacctggctaatttttgagtgtgtgtgtatatatatatgtgtgtaaaaatatatgtatatttttagtagagatggggtttcgccatgttggccaggctggtcttgaacggctgacctaggtgacacgcccaccttggcctcccaaagtgctgtgattataggcatgagccactgcgccggccgaaattgcatttttaaatgtaaaaggccccagaaggaaggagactaaatacagttcccaagctccacacagctctccccatgggcctacgtgggtctccatgctgaaacctcggggtgagggggaggccaggggagggagtcgcacagcagtggccagtgtggctctgaaggaggtgctgctatgtggttaagatttttcatactgtggtatgtacagtcttgcgttgttttcttcttgccttttaagcattgtgaattccccaagtgagtttaactgtaaatcaacttggatcctggatcctttctttgtatccgactaggggacttcaagtggtagtcctgactagccttttctcttctggagaccagggctcgtagaaacaatactgacctggaaattgtgttagtcactgctaaatggcctctctgagcctcaatttcctagtctttcctaaatttcctaaaaacgaggaaacagcttcagttacccccaaggaacctgcctataaaagaattccatgaatctatgatgtcgtaagacagcagtcccccacttttttggcaccagggaccggtttcatggaagacactttttccatggaaggggggtcggcgggtggtttcaggatgattcaagcacatgatgtttgttgcgcactttatttctattatgattacattgtaatatataatgaaataattatacacttaccataaggtagaatcagtgggatccctgagtttgttttctacaactagatggtcccatctgggtgatgggagacagtgacagatcatcaggcattagattctcataaggagcacacaccccagatccctcacatgcacagttcacagtaaggttctcactcctgtgagaatccaacgctcctgtctgatctgacaggaggtggagctcaggtggtcatgcgagcaatgggaagtggccgtaaagacagatgaagctttgctcacttgccagctgctcaccacctgccgtgtggcccagggttggaggtagtggcggggggacccctgttataagagaattgaaatgtttagaattgagtaattagatttgaattactttcagtttttttctaatagttcttcccccaatcccccaatgggtatattacatctcctctctctgaaccagtaactcaagcatatatgatctctgtcttgaaagacaaccaattgagaggtgacagcgtgctggcagtcctcagagccctcgcttgctctcggcgcctcctctgcctggactcccactttggcagcacttgaggagcccttcagcccaccgctgcactgtgggagcccctttctgggctggccaaggccagagccctctccctcagcttgcagggaggtgtggagggagaggtgccagcgggaaccggggctgcgcgtggcgcttgcgggccacctggagttccgggtgggcgtgggcttggccctgccggcccgggcagtgaggggcttagcacccgggccagtggctgcggagggtgtactgggtcccccagcagtgccagcccaccagcgctgcgctcgatttctcaccgggccttggctgccttccctcggggcagggctcaggacctgcagcccgccatgcctgagcctcccacccgctccatgggctcctgtgcggcccgagcctccccaacgagcaccgccccctgctccatggtgcccagtcccatcaacagcccaagggctgaggagtgcgagcgcatggcgagggactggcaggcagctccacctgcagccccggtgcaggatccactgggtgaagccagctggactcctgagtctggtggggacatggagagtctttatgtctagctcagggattgtaaacacaccaatcggcaccctgtgtctagctcagggtttgtgagtgcatcaatcgacactctgtatctagctgctctggtggggccttggagaatctttatgtctagctcagggattgtaaatacaccaatgggcactctgtatctagctcaaggtttgtaaacacaccaatcagcaccctgtgtttagctcaaggtttgtgagtgcaccaatcgacactctgtatctagttgctctgggggggccttggagaacctttgtgttgaaactctgtagctaactaatctaattgggatgtgcagaacctttgtatctagctcagggattgtaaacgcaccaatcagcaccctgtcaaaacagaccactcggctctaccaatcagcaggatgtgggtggggtcagataagagaataaaagcaggctgctccagccagcagtggcaacctgctggggtccccttccacactgtggaaggtttgttctttcgctctttgcaataaatcttgctgctgctcactctttgggtccacactgcttttatgagctgtaacactcaccgcaaaggtctgcagcttcactcctgagccagctagaccacgagcccaccagaaggaagaaactccgaacacatccgaacatcagaaggaacaaactccagacgcgccaccttaagagctgtaacactcaccgcgagggtcgacggcttcattcttgaagtcagtgagaccaagaacccaccaattccggacacacaatggtgatgctaagtccacaatactatgacccagggccactgaggccaggccaacgcccagtgagcagcgggacagtccacacacatcaagctcctctcgtgagtctaagctgaagccttcggccacagtgtatgactctacctacttgcttactaaaatgtgccaccagaggccttcccccacgataagaagtaaattcacagccttgggggtgatataaccgtgttcttttcccttcctttctggttctagtttcaggtggcagtgataaaaggagtgttctcctcctcttaaactctagattggaaaaataaatgaatgtgaatagacatcccccactcttcattctgtatcaaagccctggggaatccatttttaccacactgagtctcactgaagtcaaccgcgtaagctcctgcattcatttccatgagacttggcattgtggaaataattggatggcactgccctctaacactcctttcaggaaacagagaaaatgtgcctttgctagtaggtggagtgaaaactcgtctgagtgctggtaggtttcaccctgtgttttcagtattgtcttgtcaagagcagttattatcaagtcccaaatgagcctggcagtacaaccctcaataaggtgtttaaaactgccttccctagtgagaaataaaacactgcttttgttctcgtttttaaaattgactgcatagtattaccactatcaatgaggtgtttaacatcaaaattgtcttccctggtgggaagaaaaacgtttactttgtttcctttcttaaaattaattgaggtttttaaaaacttatccttattcaaccaactgtcgcataaaggggagaagagacgaaaatgggattttaaaatattgtctttggtggcccatcaaagattgtcagcacattcttcctgtttaggccacttgctgagcacttttcttcgcctttgcttcatttctcccccattatattttataaccttggcctcatcggtgcagtccttggtagggagctaatcataagatctttgcaggaatgactacattgatccatgtattggtttttttgtgtttttgttttgttttgttttgttttagatggagccttgctctgtcacccaggctggagtgcagtggtgtgatcttggctctcctctacctccgcctcccgggttcaagcaattctcctgtctcagcctcccaagtagctgggattagaggcacatgccaccacacccactaatttttgtatttttagtagagatggggtttcaccgtattggtcaggctggttttgaactcctgacctcaggtgatccgcctgcctcggcctcccaaagtgctgggattacaggagtgacccaccgtgcccggcctgatccacatattctttattagcttgcaaattttccacaaggctgctctatctattctataaggttaaagaaattgcttatgaaaaattaaaaatcagcctgtagtattaatacctaagggggctttggcagatatggctaaggatgctccttccctcatttcctcaggggattccgggggcggctctaacctttaaaactgcctctgcctgcttctgcctctgctcgaggcgtgggagttctatggccattgccttttacaagatgcagcagagaagagaaggcaggagaagcaatgccctggcttttatgggcataataacaggtttcggaggacaaatgaagacccaggctacctcatatccagataagaaattatccaatggaaaggaaaacttgaagggtgaggagggaagctagggaattcgactgctggtatggttcccagaagagaggccccttgtcctgcctacctgtacctccaaggccgaattgcaactggccagcggggacgcggcggtggggtggggcgggggggggggggcgggtggtgcggggagaaagggaagcagagaggtggggaaggatgatggcaattttaaaaggtttgggggacccatgagtaaggtggccatgcccattcccagcagaagccagcgaagctgcaagatctggagcatccatcccttctccctggcacggcacagaggagtagactagaaatgacagtgtgccatgtgtgggcaagtggactgagagggcctcagagagaacctgtgctccccagcacagtgcagtaggcgatggaatgttcacccgtgcctgagaggggcatgagcacagcagggagagtcacctgacctaaagaggcgctgctacagggatgaggaggaagcagcagtggcctttgtgggccaaaacctggtgggaagatggctatttcaggggatgcctgggagcgcctcaccttgtccctgaccctgcctttgtgcctcagcactgtgtcagctccctggaatggatactcaaattcgtacagaaggaagtaaaatcttcaggtgactgaaattaagtttccaccatttggtaggatgggaccttaaaatagaaaacaaatttaggccgggcgccgtggctcactcctgtaatcccagcactttgggaggccgaggtgggtggatcacctgagttcaggagtttgacaccagcctggccaatgtggtgaaaccctgttctctactaaaaatacaaaaaatcagccgggcatggtggtgtgcacttgtaatcccagctaccagggaggctgaggcaggagaattgcttgaacccaggaggcagaggttgcagtgagccgagattgtgacactgcactccaggctagcgagagagcaagactctgtctcaaaaaaaaaaaaaaaaaaagaaaagaacaaaaatttaatcagaggaaaatactgtagctacatttgtttacacaccttgaaattatggacagagatttgtacctaccatactcagaatttatttgaaaaaaaatgttctctgcataaacaacaaacaattattaaactttgtcaatattaccaaataaaacctaaaatgtttctaaagttcattaattggatttaaactatgtgcctttatagacatcatctcgtttatttcttatgattcataggtgctggtatccccttttacaggtaaggaaacgaagacttagaaaagtgaaataatttgcccatggacacaatgatggtaattagcagaaccagaattccaactcaggaatgtctgactcccaagtctatatttttgatcactaaattaagctctatgctgttctttcctctggctttctagatccctccaggaacattcctttctgcttccttggctgctcacatttacaaggcaatcacacattgatgaactggagccctgggtacaaagaagcacaattttttttttatccttcctgctcctaattcccaaagggcccaacaattaagtggattattgtggtcataatcttagttttttgatttaacaagtctttttttttttttcttttgagatacaatctcactctgttgcccaggctggagtgcagtggcgcgatctcagctcactgcaatctccgcctcctgggttcaagcaattctcctgcttcagcctcctgagtagctgggattacaggtgcgcacgactatgcctggctaatttttgtatttttagtaaagacggggtttcaccatgttggtcaagctggtctcaaactcctgacctctgatctgcctgccttggcctctcagagtgttgggattacaggcgtaagccactgtacctggcctggatttaacaagtcttagctcagttcttatttatctttcagtcaccacaccttgtgagttaatcattggacaataatcagcttggacagtaagttaaccactctgaacctaggtttctttgtctacgaaataaatgcaatctctaaggtcctcctccagcttaaattttccatgattctgaagaatcaggatcaagtttattggtttatgggaagttgaactgcagttctccaaataccaactcttctctgatctccatctctctcgtagatttaaatcccccacattctgggatgagggataggtgtagagcttcacaaagggatgggaaaataaaatataataatatctcaccttgtcggcatgaggaggaacatgaagactaaaaagatgaaattgtcttccttaaggctctacgaaacagcatataaaaatgtaaaaattggtataaaaaggtttttcactttggctaaaatggaagccatcctgacagcagtgcctcttagaattgccttgtgtcatttaaacctgcttactactatcgtttctttaacatcttttctggtatttggccatccttctattcatattgttttatctccatttccttgagtgtaaattcttttatttattgagtttgttattttccttgcatgatactgaccttactcagatattttatcattcttagggcgagtgcatgactcagacctgtacagtcatttcatacacctggatagtgtttatgtaagggatatatgactcaacaggacaaaagaactcccaacagaaccttaggacgctggcagaaactaccaggaaagagaagctctcttgctactgaagttgctgagctatgaagaacgtatgctgtgagctaataggaagcattttgccactccgtaggaagagcttgcctgagactgtagagacaagagaaacaggtttcctgactatattgtttcagtacctggatcccacagtcgggggagagtccccctcgggactctgaataacacagccaataaattccctttttgtttcagcacaagccattttaaatcataattttttgtcactagcaaccgaaattaatcaaacgaaaatctgtgaacctgtagagaaagtccatagttctctaacttcacatcagtagatgcccaaggggcctttctgttttttcgtttttgtttttgtttttttgagatggagtctcactctgtcacccaggctggagtgcagtggtgcgatcttggctcactgaaacctccgcctccctggttcatgcaattctctgcctcagcctcccaagtagctgggattacaggcgcccgccaccactcccggctaatttttgtatttttttagtagagacggggtttcaccatgttggccaggctggtcttgaactcctgacctcaggtgatccacccgcctcagcctcccaaagtgctgggattacaggcatgagccaccgcgtagaggtcaattgcgacactacaggaaaagaaggtaaagtggagtcacatctgacttccatttacatgctggttttagaaactcacccccatgaaagatataacttcgcaatctacttaatcctcacagcagcaaacaaatttattaacatttattaatgttaaggcttaatgtaaaaacaatggcataaatcctgcaggtaagtaggaaaacttcagaattatccatctgctgtcgatttatcactagagattagattttatcctgaacgcatattttgggaatatctaaatatctgtaatatggtctctccagaattttcttacatgatgtggaaatcaagagctacctgcctgaagttgatagatttaaaaatgatgattaagtataatatttgaatttatgacaggtagccaacgggaaaacaataaaagataacaaaaattaggagaaaaaaggggtagtgtaaatgatatggatttctcagcttcaacattcaggagtgaaataagtactgcttaaagttgaaaaaataagaaatggaagtataagcatttaatttggagttatgaaaataatcacccaaagaaatcaagatagaaatgacatgaatgctgatgtccacagagtgggaccaggttgagtgagggagattgtttgctttcatttatgcctctttttttctacttagatgtttcatttttgtgtgcacacattatatttttattttattttaatttttgagacagtctccctttatcgcccaggctggagtgcagcggtgcgatcacaactcactgcaacctcgacctcgtgggctcaagtgatcctcccaccttagcctcttgagtagctggaactagaggtatgtaccaacacacccaactatgttttgtattttttgtagagacagggtcttgccatgtagactaggctggccttgaacccctgggctcaagtaatctgcccaccttggcctcccaaagtgttaggattacaggtgtgagccaccacgcccagcctgtaattttaaattggccaaaaagactatgttcatctaggcagcctgctcttctgccctctaaaatatccattgcgagcattctctgcaccatcagatggcctccatgtcaacgtctcagctccaaacttacaaacgtcttcttttaaaacagaggaagtgtctgcccacctaaggttaatctctccacctgtgtgtggatcccagccacacctatgtctgcagaaattgctaattaccctctttttcttcagatcctcaaactctccttttctgtgagttgccttcaagcagtgggcaacatgctcaggctactcccatctgaaattgaagccaccttgaccccatgaccctgtccagcttcctctatcttctcccctttacagccaaatatctccatttccgactcctgaactcactctgatatggagtcttcatcactgcagtaaaaacggcttttgccaagctcacaggtggctccagtccgtaatcagactgttactacctatcttcatcctacttgatttctcaaagcttctaacagaggggatcactcttaaaacattctcttactttttcagaacatcccaccttatcactgtaatttggcagatttgtgtcctcacacatcattagcataaaatatttcccctcaccatgaagtatttctcacatcaagtcataaccttggccataactggagtatttgctcctcacaagcctctccacatgcagaccttcctgccaaaggctttcttgcttccacagtcacatccaggaacaggggcaatcccttcatgttgctccatgggaaagccatctgcagaaaagccagcttgccgctggaatttttattggatgtcttcagagagatatgctacagaaccagtttcagtgaatgggcttccacttacagcagaaaatttaatcctgtgaactcagtcacttgtttgaaactcaatttgggatgatagtggatctttctcaattcattagaattctctcccttttctcctctgagtagatttctagtgagggcagtggtggggtgaggcttggttatcatcctagcattgtcttgtgctttcttccctgtgggctctgctgggagtataactgcttgatctaccagcacaagcaatgcacactgatcatttcaggagaggttgagggtcctctcctattgatgcggcctgacgggcactggtctgatgacttgctgaaaactagctgcatctccctttgctgacaagctgaccacccctagcctcattcaccttggaccctggtgcttggtaggcacttcaccattcaactctttcttgggaaccttttggatctcctctaggccctgtgagatatatgtgcgtaaatgcgtgtgtgtgtgttatgtatatatacacacacacatatgtatatatatatacacacgtgtgttaggagcagaggagggagttgtatagttggttatcaaagctataaaaggccctttctatgttcatttctaaaggccaacgcatacaggctcagggcacgattgggctgtcttctctcagaaactcgggcagagccaagtccttctgctcttagacccaaaatctacctagcaatttctaacagccaacacttcccaccctgcatcttattccctactcccatagactttcctagttatcacctaaattctcctctcaccttttctctcagaacgtctcccccagcttagagaggaatttgtctctgtaggtgggagggtctttaaaaaaaaatgaggccgggcacagcgactcatgcctataatcccagcactttgagaggccgaggcagaagaattgcttgatattaggagttcaaaaccagcctggacaacagtgaaaccttgtttctacaaaaaaataaaaaattagcctgtcgtcgtggtacccgcctgcagtcccagctacttgtggttcatagtctttgaatctttatatgcaaagtcaactttttaagaatcaaaaaagaaaaatgcatgtatcttttattccaagcacctggtttttgcacaagtactccatctttcagactctatcgcttttattataattaaaaaaattgtttgaaattcaggctctacttgttctcctttcaaggcaatgaagcccatgagtgggaagaagactacagggcaacaagaaaaaaagtgagaacattattattattattttttgagatgaagtctcactctgtcacccaggctggagtgcaatggcttggtctcggctcactgcaacctctgcctcctgagttcaagcgattctcccgcctcggcctacagagtagctgggactacaggcacgtgccaccacacttggctaacttttgtatttttagtagagatggggtttcactacattggccaggctggtctcgaactcctgacctcatgattcgtccgcctcggcctcccaaggtgctgggattacaggcgtgagccactgcacctggccgtgagaacattcttgatttaaaatgcacatatataatctaggtatgcgatcatagcttcttttacttgccatggtccccttgccaaagaattcatgaaaggagaaatcgtaatttctccaccttttaaatagccagatttctgcaatccgtccaccccctctagattttcagcaattatctgtgaaaaggaggaaagaacagcaaactagaagcaaaatcacaaagcttcaaaatttctttgtgcctccgtttttatgtagtttcttttggtatggcaggaaaatgggcaatattgttttcatacaatagctgtattttgttccagcatgcacataaattacacagttaaccttatctgatcttacctaaagtgacctttttttgcttgcttattctgattcatgcatttttacatcaaagtctacatttattgaaagaaaaatttcataatttatatcatttaacgtatttatcttacagtgcatgtatacctggaatgggaaacgtaacaataagccagccagcagttagagtacgtaactgtgggaaatgtaaagtggaaaaaaatatatagaaggaaaaaacagctctaacagggagagaggtttggggccctatagataaataggtacatttccactccacctccggacatctgccggttggtggtaaagctgttgattttaggaaattctagagacagagcgttgtcggggtgttgttttcctactgaccagaacaggaaggcaatgcctggattaactagagacctaataaactgcgggaacaagccctaccgctgcggggccagggccagcttcgaaggctgcaagcctcacggcaacacggagccaggtcctcgtgtgaccttactgtctactgctgctatgtaaggggactggcactcccgccctcctgaaggcgcggagaccccgacggcctcggaacgcttcgctcgggcacactgaaagcagcgcgagacgcagctcccaacactctaacatggaggccggcttttgtttgttttggccccgctcacacacaggcgtctcagggcggagaccacaggccccgcggctgcgggcggctcaaggtcccccgggacgcccccctagcggactttggccgccgcgcccggctgcctcccttgcccgggccctgcccctctcgcctctgctcccggcgccgcagctgacccggcgggggaggaggacggcaggagcgcgcggcgtcacaaagcgaggacagaacgcccggggttccgccgagactcggtcgtcccaggccagctcgacttgcagtccgccctcgtggggcgggagacgcccgacgcccgcccacctcacccccggggtgccctccgtggcctcacggggacgcagcgtcgcagcggccccggcgccgcaaagcgtcttgggagcgccggctcgcgccggaagaacgcgagggcgcgcggcggcggcgaggttataaaagggaagaagccggcggtgggcggaagtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccggtgagtgaggcagcgtccctaaccagcacgcctcgttttgtgtgccacctgcagaccggggcccggcgccctccgcgggaccggcctcggcggggaggggaagttgtgaagcgcgggaatccgccggcccggctgccctctaagggggagaagggcgtccctgcgaggagccgacatgattcccggacgtctgtgtgcccggtggtgtgggcgcagctgctggtagggttgcttgtgttagggaacaacgctcttggggacgggtgcgagatttaagattagtgaggaggtgccctgcctcccagaccctggggcacttgtttatggggttccaggaaacagttcttggcggttggttcactttcttgattgcagccaggaaatgcagtccctgtggcctgttttttgcacaagtaggaccttagaaaaaacactttttaaaaatgacttttccttctttttcagataccctcaaaaagttatggataaaatacttagtatggctgaaggcatcaaagtgacagatgctccaacctatacaacaagagatgaactggttgccaaggtgaagaaaagagggatatcgagtagcaatggttagcagatcatagatgtgaacatacataggagtttagagcataagtttgatataattaggaattattgttactaatttttttaacaagccagaatttttatgttattaataagtaataaagttggaatgttaaacctaaagtatatatctgtgtctttaggctttgaatttgatagtttgctttgactgctttagattttgaagtgtccactgttgtctgatgctgttatttttttaatattagacattcatgatgttattcaacactgttttaagaaattaatgactccacactttttaaagaaacgattagtcttgaaatgttttcactttgtgcctttattttaatgtgtatttgtctcatcacccgttttgtacgaggtattcttagtcacatatctatgtttttcttctttttagaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaagaagttgtgttttttttctccaagtcagaaccaattcctgcaaataggcttcccatgacttgtcattataaattagacaaccaggtaattgtgtgatatacatctttatttaatttttttttttacagcaatcccctgagccagaatagattaaaagcgattcccttcaattttcaaatctagaactggatggtttttgtgtttatgcatcttttagaataccggaaagaacagagagccgtgttcagctcttgataatgagcctattcaatttaactacattcgttaaaatgaagtggaattttgttttcgtcttaggtgattctgcctgtttgtctgtcattgtatattctgtttactttgcttcaaactggccccaagatgttatttttgtggtttctggctttctagattctatttttagatactgcccattgagcaataatggtgataatatagagagaaaagaaagacctttcatgggccagttgtgttggaataggaaaatcaaacgtaagcacaatttaagtatgtagcagttattcctattttgtattctaggaataaaaagatactttaattttttatgctagaattacataattacataatcagatgttttaattttaccatataacctttaaaaatgattcatttttgaggatatttaattggataccaaagctaaaatccatatactgtaagtgggttgcctttatagattgcgggacacaataacatgaatgtattgtgaaagcacttttagttacctcactttcctcagtcttggaatgtgtattttgtgggataatgattatcagaaaagcaaaaaattacaacgaacaaataaatttatataatatatccaattaggtggtttggtaatttcctaaattggcttgtttcaagttactatgaaggttattgagaatgttttatagtgacttttgatgtggaggaagttgtttagtgtacatttatgataatcctatttaaaaacctagaaaaatgctcttggttaataacatttaaagaatcctggtttaagagaaatgcatattttagaattctattattgagagtgaatcttggctgtctcttactagacatgtaacctctgggaatttaaccttttaaccttacttcgtctgtgaaataggactaatagctgtctcatagagcatggcagttagatgagatgatacattcaaagtgcccggcatggtgcagatatcccatggttcacttatatattcttattcctcttacaaggagctcttctcatttggcctacttttcagatggagaaacttacacagagtaattcggtcagataattcaagcccatatctgatttcaaaacccaagctcaagtatgttgtactgcttattatccttgtcacttctctatatgctgaaatttctgaaaatccctcccagaacgtgattttttaccagattaagtgaccgcatctttctaaagcctccttgaaatgagtcacttcagaggctcttctattattaatgcttctaatacttgcatatcttgaatatcctcaactagtgaatcatcccatatggatgcagttgaactttgtaaaaagaccatacacacacaaaagaaatctgcacaaaaaaccccccaaaaccaaaaaaccaaacacacctgcctaaaatagtgtataatcaagttgagtgaataaagtcggctaccaagatgggatatactgcttttttcagatgagtgaggggagacgatttcctgagacatcaagatttttcttgatgttagaatgagattttttttttaatggtaaaattagttgacttgtaagaatgatactgtcatgagtttttgacctaaattcttggagcctgtcactgctgtcattggctaggataattgtcatagggatatgtgtaactttaaggcctttgatatgtattatcaggagcctgctccaatttgaattatgttttccctgccaagtgcagcttttcttggtacaaatttctacttgctgtttagatttttgagtaacagcagtgagaaagtaacaaaaacaagccgcaattgggaatcaggtcagtcctacaggtattgtgttactactttgtggactttgtcctcaaaaattgtgctgaagtcctatattgacctactttctagacattggttatccattcctgcatgatttttaaataatattttctgtgattgatgaataaactatttcactttctactagaacaaaatgttcaagttgaatgaagggttaagccatttattgcccaactattcctccccaagaaaaatatcaatcatatttctttggcatccctgcacacagcttagttgccatccagttagaaccatttcttactaccaactttaattttaatatctctcgattttcctccttttgtttttgttttgtttttttgtttgttttttttttgagacagagggagtcttgctctgtcacccaggctggagtgcagtggcgtgatctcggctcactgcaacctcggcctcttggggtcaagcaattctcctgcctcagcctcctgagtagctgggattacaggcgtgcatcactacacccagctaatttttttgtatttttagtagagacggggtttcaccatgttggtcaggttggtctcgaactcctgatcttgtgatccacctgcctcagcctcccaaattgctgggattacaggcgtgagccactgtgcccagccgatttttctcctttaaaagtcattatctgaaaattattagtttttaaagttctttttctgttcctttgctattcatctagcaagaaaaagagtagacaaggccccaaactaaatggacttttaactttgaagggaaaaaagaaaagtaatgctaggttgggcatggtggcccacaactgtaatgccagcactttgggaggccaaggcaggcggatcacctgaagtcaggagtttgagaccagcctggccaaaatggtgaaactttatcttataaaactacaacattagctgggcgtggtggtgcgtgcctgtcaccccagctacttgggaggctgagataggagaatcgcttgaacctgggaggtggaggttgcagtgagctatgattgtgccactgcactccagcctgggtgacagagtgagactccgtgtcaaaaaaaaaaaaaaagtaatactaaacacaaagggttggatacaggacattttgagtaaaaactagagattacatatgccagtacttaagaagcaatcagaaatactttgtgaatttgaaactttattgaatagaatcagaatccttggaggtcttaggaagcaaccaaactaaacaatataagtagtaaatacactaaagactaccattttactgaagtgggactatcatgtgcaatgtatataacttggaagctagagacaaatgtacaaaaaggtgatttgggagggaatcatctagtgatttccttatactgttttcagtgtaccagggcttagacacttaaaaatgataaaacccaagttctgaatatgtcatcagtggttttcaaactttagccatatttcttcaaagaaaaatgggggcattgtgtatgtaaaacagagaactactttggtcaaaggagggtggccacaccctacaactgaattatacgtttggttcttaatttctttttctttttttttttgagacagatctggttatgttgcccaggctggagtgcagcggttcactgcaacatctgcctcccgggttcaagcgattctcctgccttggcctcctaagtagctgggattacaggtgcgcaccatcacacccagctaatttttgtatttttagtagagatggggtttcaccatctaggccagactggtctcgaactcctgacctcaggtgatccacctgcctcagcctcccaaagtgttgggattacaggcgtgagccaccacacccagcctctgttctcagactcaatttctgagctacctccttggactatgagcagaggggatgcagcaactaggaggcttagtgtaaacagccagcctccttctgcaataggtgttagagtggatgtgggtcgaagctgccagtttactacaaagttgaactaattagttttttaaagtagtatgccatattaaaatttacttgagtggggactcagatcgggtttaagggattattacataaattaacatttaagtaatactaaaaatagctgccttttgtttctttttattgtgaaatacaattgcaaaaacccataaagtccacacatgtaaagtccaacaattactgaatgcccatataataattatgtaagccaaaaaataaaattttatcagcacctcagggacccaaatccagtgttcttacagaagacttgaacagtggtttggttctgatttggggcagtgaatgtaaatgccagtgagacgtgctgtcccatgatccttgtttcctatattccagaaaatagtaagcgaaatgcacactttgaggaaaatttgagaaattttatgttcaactatttaggaagcttctaaaaaagtaaactttaaagaaaacttgatgtgaatcattagaaaatttttctagacattctatttgtagaattcagggacaatttacagaggcaatgatataaccaatgcgtcgagacgcatgatgtatcttaggaatgctgtctgttactcttcaccacttgcatattattaaataattttctatactagctaaggaaaaaatgattctcatgaaataaaatctgagttcccgggaagcatttctagtgtatcttagctatgtgcactgatagtggatcatatatacttaatgcaggagtttatcatgaatgctcaacctgcagtttggaaactagtatggggtagaaatatgtgcacctttctgtctttgttttttgtttcaaaataatattgtatgtgattaacaagagaaataagatggagtaaaataaggatactattttgaaaatattcactacactcccctgtaatttgcattctctagcaatcattctgccactatggttctcatagggaaggatgtcaaggaggaggttaaagaggcaggcatttgagacctgagggtcctgacctctatgacagtggtccccaacctttttggcaccagggaccagtttcagggaagaccatttttccacggatggtgggtagggaatggttttggtatgattcaagcacattacatttattgtgcacttttttttttttttgagatagagtctcgctctgttgcccaggctggagtgtagtggtgccatctcagctcactgcaacttccacctcccagattcaagcgattcttctgcttcagcctcctgagtagctgggagtacaggcatgagccaccatgcctggctaagttttgtatatttagtagagacagggtttcaccatgtttgtcaggctggtcttgattgaactcctgacctcatattacctacctgcttcggcctcgcaaagtgttgggattacaggcatgagctaccacacccagcctgtacactttatttctattgttattactttgcaatatataatgaaataattatacaactcaccataatacaccatcagtggaagacctgagcttgttttctacaaccagatggtcccatcggggggtgatgggaaacagtgacaggtcatcaggcattagattctcataaggagtgtgcaatctagatccctcacatgcacagttcacaatagggtttgtgttcctatgagaatctaatgccaccgctgatctgacaagaggcagagctcaggcggtcatgtgagcaatggcgagcagcagtaaatacagatgaagctttgctcactcactcgctgctcacctcctgctgtgtggccccgttcctaacaggccacagactggtactggaggcttgcaggttggggaccccctgctctatggtgtagcatgaatttcacctgtgtcaatatagcagagatgagagtgatgacaattttcatccaatgatcctgctgcttttttttttttttttttttttgagacggagtctcgctctgtcacccaggctggagtgcagcggcgcaatcttggctcactgccagctccgtctcccgggttcacgccattctcctgcttcagcctcctgagtagctgggattacaggcacccgccactacacccggctaattttttgtatttttagtagagacggggtttcaccgtgttagccaggatggtcttgatctcctgacctcgtgatctgcccgcctcggcctcacaaagtgctgggattacaggcgtgagccaccacgcccggccgatcctgcttcttttatcccctggctgtaattaaagaatgcatcacttcttaggaggttccaagagagcaaagcaaagagggcttgagtaagaaatagtgaaagcatcaggaccttaaatacagagccacctagctgtacacaccacggggagccgttcacaagcaatgtaatagacatcagttactacaatgagtggtgccccctgaagttgtggaagaaggtggccctttttggaatccctgtgattgctgtatatagtgaatttatttttaaaaccttactttaaaaaggaatttggttctgtaatatggaaagagctgctaaagaaaggattttgaaaaaaatagtattaaaggtctatgaagcattgatagcacataaattctaagaaactcttcttggaagtagcatatatgctagttatgtgctgatactgggggcactatttatacttggtcatgaattactttgcccaacatattcttctacaggagggattatttcaagactgtcctaaaataaaagcacataagataatgtaaggctgcttagattatgttatatttgttttgtttctattcccaaaccttgggggaaaatcaggaactagacagatgaagaattgtgttggctcagatacggaataaaacttgagtgtctgctttgtgttctctcctacaaatagataatgtcccttaatttatcacatcacttgtttctgaacatttggtgtaaacccaccatctcttgcccagtttcattttcatctattgctcctagctttcccaagataacatggcctgagccaagaacatacttgaattcaaagctatgggaccagaatgaaggttggttaacctatctgtccctgggcattagacaacagacccttgaagcagctaaagcgcctatcctgagctgggcaccttgactgccatccccactgagaccatatgacctgggtatgggtggctgggcagtagtggtggtggggagaattcctgaaagttctcattgcctcagggatgactttccagagggatgttttaaccataaaaggaaaaaatgtgctgggcaggccaaaatagatgtcctgtagaatgactcagggtgaacaaacagccgttgagacctccaataagttcttgccatggtccacgctgtacgaagatggtcatgaaagccatccagcactcccaggtcctggagcacactctccccattctcaaggtctttctcctagcaagttccccaaacactgtgcctcagaaagaaaaatggtcaggagatttccctcagaaactcaaacaactgatcagaatagggtgatgctggtgccctcccacaacggatttcctccccctggttcctgtggttttcattctactggtctccaagctgccatcacatccagccaaagcaactctttgctgccaatgctgccaatatgggcagctttttcaccagatgtctatcgattaaaaccactggtaagagccattgaacgatgccaacaatcttatcttacagtggacttggtctctcttagtttcctaccctaattttttggttatcactaccttcctgggaaagctgtttccactaagataatctgtaatgttttgttccttccaacagttagacagatggtcatcacaaatacagtacgtgcctttaaatctgatataatctgtaaaaagaatagatcactcaatcttccttattctatcattagcaaaaaattacttgtgatatcacttagagccaatgggtgtcacgctgatgaaaatgaaaattgctgcctcctcaagagatgaaagagccagactcacagcattacgcccttttagacaaagtctatctcaggagagtccggtagcggtgtagctctttggttttcttccactcttcaggagaaattgttagtattctagcaacactgttttcaggcactggctggaatacttagcagggagaaaactggccactcttgagtgttaatgaggctcaaagcatgctagcacgtcctaagcacagggtgcctgtcctaacatcaggcattttcacccatgtcctccaaaatacttaatctatcaaaaaatcccagaaacccgagagtctgcggagccctgaggtatacagcggacagtctcacattcgtagaccctatgggccacattatgagccaacaatgacagtctgaaaattgggaccaaacattactccatgaattaaaaacagcagcagcaacttaaaacagcaatcagttctatgaagcaagagctcaaagcagaagtgtggtagctcagggaagaaagaatgagcaccaggaatacataaaacataggctggagggactcaggaactgagaggaagcagtaaagtcagcatagaattgaaaacgagatcggaagaagcacaggcagagaagatgctgctgacgacacaggagcagagtcgaaagcataaaagtggatcaaaggaagtatcaatttgggattttaaaatttgagcgaaatgacagagaaaatagacaaaggaggtgaagagcataattggagtctcaaaaaataaagttgaattgttgaacaggacaaacaataatacttcaaacatttttataaaataaaataggatcaacatgctgaaagagcacaccatatttcagggaaaactggcctataatactaaatattcatatatatatatatttttgagatggggtcttgctatattgcccactctggtcttgaaatcccaggctcaagagatcctcctgcctcagcgtcctgaaaaactgggactacagatgcatgcaccatgcccagctctaaatatttacatgtatcttaataaaattattggacttcatagattttagaagggatcctttgggtgtccaggcaaaaagttcaagtaatgtataagaaaaaactcagggtaaattcatacttcatagcaacacgaagcaccagaagacactaagaaaaaattgtgaagaagaattttatccaggcaaatgatgattccaatacagacacaatttttaatacccaagaactcaaggatattgtcccatgaactctgcataagtaaggaagttttaaccagcaagctgaccgggaaagttagcacaaagggatgggaagcaatcactgactctattttttttttttttttgagacagagtcttgccctgtcgcccaggctggagtgcagtggcgcgatctcagctcactgcaacctccgcctcccaggttcacgccattctcctgtctcagcctcccaagtagctgggactacaggcgcccgcaccacgcccggctaattttttgtatttttagtagagacagggtttcaccatgttagccaggatggtctcgatctcctgaccttgggatccacccgcctcggcctcccaaactgctgggattacaggtgtgagccactgcgcccggctaactttatttaacagtataaccaagatgaaagcaaactcagggattaaagtgacagaaaagaaagtaaattttatattttctgataatgtagaaatgatataattaataaaagttggagcagaaaagagaaagaaggtaggtagaaataagtgtgcaaatttactcatctttaatagatgaggtcagcgtttaccattcaatgctggcgagtcaaataatagagggttttaggtttttaaaaaacacgctgaaaggtaaataatgagaaagataataaactaaatttgggaatagtattgatatggtttggatgtttggtccctgcaaatgtcatgttgaaatatgatccccagtgctggaggtggggcctgagttcacatgagatctggttgtttaaaagtgtggcactgtcctctctctctctcgtccccagtctcaccatgtgacacactgactcccctttgccttctgccatgataggaagcctcctgaggcctccccagaagcagatgctggcaccatgcttcctgtgcagcctgcagagccgtgagccaattaaacctcttttcttttccttttttttttttttttttgagatggagtttcgctgtgtcacccaggctggagtgcagtggcacaatcttggctcactgcaacctccgtctcccaggttcaagcaattctgcctcagcctcccgagtagctgggattagaggcgcctgccaccacgcctggctaatttttgtatttttagcagagacagggtttcatcgtgttggccaggctggtctcgagctcctgacctcagatgatccgctcgcctcggcctcctaaagtgctgggattacaggcgtgagccactacacctggccttaaagctcttttctttataaataacccagcctcaggtattcctttatcacaatgcaagaataaataaatagatactctctaaagaagtgagagattaagggcacaatataaagtcacatttagaagggtaaactctgggaggaaaaacccaaatcttcctacctttcaaaagaaaaacatatacacacaacacagaaaataggtcatacagtgacatcttttaaaagatgtaaaaagagaaagcacaaaataaataggacagaatcaacaccaaatgtatgtggctcatcaaaagtataaatgaataaacttacctatataaagaaaacaattttcagattgaatcataaagcaaaatacaactttatgctgcattcaggggacacaattaaaaatacgcaaaaagtttgaaaataaaaggataagcaaaaacatatcattaaaagtaaaaaatattaaatgaggtaatgtgtagagtgcttacaacattgccttgcacctaatgtgtagtattaaaatatcaaccaaaaatagacaaactatccaaaaacaaagcaggagttgagctcttactgttagacaaggttgagttcaggttcaaaagtaagaaacaaaacaaagaagagcgcttcataatggcagacgacataattcacaatatacatctaatagttatgaacagttaagcaccaaatagcagagagttaacattcaatattcaaaaggaaaaattataggagagaccagaaaaacagacctcagtgcactgatgactttcaatcgcctctcaaggtccgtgacagatcaactggacaaaaatcaaggctacagaggagctagataacacagttaatgaaacagatctcagttatatatccaaatatatatcaaatgatgattgctgaaaaaaggcaacggtctgtttttacaagtattcatggaatattcacaaaaatgaaaacgtacagacaacaatctcaatcacaatgcaacgaaattaggagttatgtaataacatcacccaaaacaaaaactatctgccatctggaaactttaaaatactttcttaacagctctggaattcaagatgaaatcaaagtagaaactgcaaaatagcaaataaaaataatagaaaacattccatatttgtatgtatgggatatgaagcttagctacagagtcaaagtaaataagaaggaaaatacaaattagaagaataaaaaataaatgtaaggaaagcagaataaagaaatgaataatgataaaatcataagttgatgaaatagaacaattttttaaatccacagaactggaaactaaattcgaaatctttttttaaacaataatataggcgaggtgcagtgtctaatgcctgtaatcccagcactttgcgaggctgaggcaggaggattgcctgagcccaggagttcaagaccagcttgggcaacatggtgagatcctgtctctacaaaatatattttaagaaattagctgggtatggtggcacatacctgtagtcccagctactcaagaggctgaggcaggagaattacttgagcctgggaagttgaggctgcagtgagctgtgattgctccactgtactccagcctgggtgacagagcgagaccttgtctcaaaacaaaacaaaacaaaacaaaaacaataaaatggacaagccattgcttaacctaatgaaggagaaaaacaagtacgcaaataagaatttattgaggccgggtgtggtggtccacgcctgtaatcccagcactttgggaggcccaggtgggcagatcacctgaagtcaggagttcgagaccagcctgtctaacatggtgcaaccccgtttccactaaaaatacaaaaaaattagccgggcgtggtggtacatgcctgtagtcccagctactcaggaagctgaggcaggagaatctcttgaacctgggaggcagaggttgcagtgagctgagatcagccaccgcactccaacctgagagacagagcgagactctgtctccaaaaaaaaaaaattactgataagaggaaagtaaccacaaatatagtggaaatctcatataaaaatgaataaaattgttttctagaaaagtgtcatttaccataatcgattttttttttttttgagacagagtctccttctgtcgcccaggattgagtgcagtggcaccatctcagctcactgcaacctccgccttctgggttcatgtgagtctcctggctcagccacccaagtagttgggattataggtgtgcgccaccacacctggctgatttttgtatttttagcagagatagggtttcaccatgttgtccaggctggtctcgaactcctgacctcaagtgatccacctgcctcagcctcccaaagtgctgggattacaggcgtgagccaccatgccgggcccacaatcgatttagaagagaaaaaaatttaaacagatcaattaccataaaataaataggaaattgtcaaaaaaaagacccctcaaattccagcagttccagaggaattctgtaaaacctttaaagaaaagacaactcccatatcttattttaattttttcagagcatataaaaagaggtaacatttccagtgtttagttaatgaaccaagtatatttctacagaaatatattgttattattaataggtataagaagaaaaattctatacagatatgtatcacttaatgatggagatatgctctgagaaatgtgtcaggcaattttgtcattgtgcaaacatcatagcatgtacctacgcaaacctagatggtagagccttctacacacctaggatctatggtctggcctataggtatggcctactgctcctagactacaaacctgtgcaacatgtgactgtgctcaatactgtaagcaactgtaatacaatgctaagtatttgtatatctaaatatagctaaacatagaaaaggtacagtaaaaatatggtacaaaagataaagaacgaacgccttcacagagcactcaccatggatggagcttgcaggactggaagtggctctgggtgagtgagcgagtgagtggggagtgagtgtgagggcccaggacattactgggcatgggtatagactttataaacactgtacacgcaggctatgctaaatgtataaacaataatttttctttcttcaataataaattaacctttggctactgtaacttactttatcgagtttaattttttaaacttttttgtaataaaagcttaaaacatgaaaacattgcatagctgtgcaaacatatttataagctttttcatgttttttaaaatttttattttttatgtttttacttttaaaacattttttgctaaaaactaagacaaacacacacattagcctaggcctacacagggccaggatgatcggtatcactgccttccactcctacagcttgtcatctcctgtaataacatgccttcttctggaataactcctaaaggtcctgcctgaggctattctacagctttctttccttttttttgtgatgcagtcttgctctgttgcccaggctggagtgcaatggtgtgatctcagctcactgcaacctccacctcctgggttcaagcgattctcctgccacagcctcccaagtagctgggactacaggcattcgccactatacctggctaatttttgtattttaaatagagacggagtttcaccatgttggccaggtcaggctcaaacttctgacctcaagtgatccgccggctttggcctccccaagtgatagaattacaggcgtgagacaccgcaaagcaggagtacactcaaaaataacaatgaaaaatataggatagtaaatacataagccaataacatatccctttattatcaagcctttcattatgtgctgtgcatgattgtatgtgctatacttttagatgaccggcagttctgtaggtttctttacaccaacatcttcacaaacacgtgagtaatgcattgtgttatgatggctatgatagcactaggtgataggagtttttcagctccattataatcttatgggaccaccacggtatacatggtccattgttaccaaaacatcgtcatgcagcacataactactcatgtctaaaaaagctatcaaagacattggaaaaattccatattcatacttgatgtaagttcttaacaggagtatacaaatacgttgttagcataatgaaatatatttatctcaaccacaaagaatctgtttaatatggaaacagcgtggatgtaatattgaaacactcctgctaagttatggacaagataagcactttttttttggtggggggatggagtcttgttctgttgcccaggctggagtgcaatgccgcgatctcggctcactacaaccttcgcctcccaggttcaagcaattctcctgcctcagcctcctgagtagctgggattacatgcgcgtgccaccacgcccacctaatgtttgtatttttagtagagatggggttttcaccatgttggtcgggatggtcttgaactcctgtcctcatgatccacccacctcagcctcccaaagtgctgggattacaggtgtgagccaccctgcctggcaagtactatcttaagctgaggagatacgccatttctcttactgtttcctgtccctgaagagaaggaggaagtaaaagctgaaaaacaacagaaatgaagtcagtggcaagaccaaccggtgccactgaccaggcctgaggttaaagattaaccccccactctaactacgtgtattacctatagatcacttgctggatatctttcacgtagacccccatagagttgtaagcccttaaaagtgtgtccagacttggttccctctggtggattcttggtctcactgacttcgagaatgaagctgcggaccttcacagcgagtgttacaacttttaaaggtggtgtggacccaaagagtcagcagcagcaagatttactgtgaaaagcgaaagaacaaagcttccacagagtggaaagggacctgagcaggttgccgctgctggctggggggtggccagcttttattcccttatttgtccccacccatgtcctgctgattggtccattttacagagtgctgattggtccattttacagagtgctgactggtgcatttttacagagttctgattggtgcatttaatcccttagttagacacagagtgatgattggtgtgtttttgcggagtgttgattggtgcacttacaatcctttagctagatgccaagtgctgattggtgcatttttacagagtgctgattggtgcgtttacaatcctttagctagacacagaatgctgattggtgcgtttacaatcctttagctagacacagtgcgctgattggtgcgcttttatagagtgctgattggtgcgtttacaatcctttagctagacacagagtgctgattggtgcatttttacagagtgctgattggtgcgtctacagtcctttagctagacacagagcgctgactggtgcatttttacacagtgctgattggtgtgtttacaatcctttagctagacacagagtgctgactggtgcgtttgcaatcctctagctagacagaaaagttctgcaagtccccactcaacccaggaagtccagctcgcttcacctctcaaaaaggccaggaattttttcttcagggagcttggttcttgagatgcaagtctgccaaggttcccagctaaataaagcctcttccctctttcagccggtgtctgaggagttttgcctgcagcccatcctgctacaaagcaatataattaaatgagagaaaaccagcctggtcaacatggtgaaaccccgtctctactaaaatacaaaaattacccaggcatggtggtggatgcctataatcccagctatttgggaggctgaggcaggagaattgcttgaatctgggaggtggaggttgcagtgagctgagacggtgccattgcactccagcctgccattgcactccagctgtgcgacaagagcgaaattctgtcttaaaaaaaaaaaaattcaatgagagaaatatatgtttaaacattggaaagaaggtaaaatcattgttatttagatataattgtatactagaatttccacccataatcaatttaaaaatctaaataaataagtgaattcagtcaagtacctgggtatgaaattaatgccaaataccaatacaaatctggtgctttagaatataaaaataaccaaccagaagacataatagagaagaccttatttacaatagcaacagaaaataaactatttagtgataaagaagcatttaaaatctgcatgcagaaaacattgaaatactaagggacaagaaggaatttttcaacaaacaggaaaacacataaagctcttagatacaaaaattaacttcataagtgtaatagttatgtttgtttatctatattttaacatgatcccaagaaaaataccaagaggatttgtatactagataagctgattcaaaagtttgtaggaaaaaaaatataagtagtcaggaaaactcagaaaaaaaaagaataatgaaggggtattatccctacctgatattaaaacatattttaaccctataaataaaaacatattttaacccttggagtcataaaagttaaaattgtatagtagtggagcataacaagataggagataaatgggagaaaatagaaagttcagaaatcagtcaaattttctagggaatataaaatatgataaaagcagcattttgaactagtgggagaaagatagcttaatcaaaaactaaattaagtagcaaattggaaatgaaattaagatccatctctgctctccaacttacaccaagataaattcaaagacttaaatataaagtgtaaaactatgaaagtactaacatgagcaaattaatcttgaagtatggtgtggggtgggggctggtgctttctaactttgacacaaaattcagaagccattaaaggaaaataccaattactatgctgatatgttttggttgtgtccctaccgagatcttaatgtgaattgtatctcccggaattcccacatgttgtgagagggacccggcggagggggggtgattgaatcatgcaggccagtctttcccttgctatttttgtgatagtgaataagtctcacaagatctgatgggtttatcaggggtttccgcttttgcttcttcctcattttctcttggtgctgccatgtaagaagtgaatttcacctccccccatgattctgaggcctccccagcccacatggaactgtaagtccaattaaacctctttttcttcccagtctcagatatgtctttatcagcagtatgaaaacagactaatacagtaaattggtaccattagagtggggtgttgctgaaaagatacctgaaaatgtggaagcgactttggaactgggtaacaagcagaggttggaacaggttggagggctcacaagaagacaggaaaatgtgggaaagtttggaacctcctagagacttgttgaatggctttttccaaaatgctgatagcgatatagacaataagatccaggctgaggtggtgtcagatggagataaggaacttgttgggaactggagcaaaggtgactcttgttatgttttagcaaagagactgacagcattttgcccctgccctagagatttgtggaactttgaacttgagaaagatgatttagggtatctggaagaaatttccaagcagcaaagtattcaagaggtgacttgggtactgctaaaggtattcagttttgtaagggaagcagagcataaaagttcagaaaatttgcagcctgactatgcaataggaaaaaaaaaaattttctcgggagaaattcagtgcagctgcagaaatttgtgtaagtagcaaggagcctaatattaatccccaagaccatgggaaaaatgtctccaggccatgtcagagaccttcatggcagcccctcccatcacgggcccagagaccctggaggaaaaagtggttttgtgggccagggccagggtccctgtgctgtgtgaagcctagggactcagtgctgtgcgtcccagcccctccagctgtggctgaaaggggcgaacacacagctcgggctgtggcttcagagggtggaagccccaagccttggcaacttccacatggtgttgagcctgcaagtgcacagaagtcaagaattgtttggcaacctctgcctagatttcagaagatatatggaaatgcccagatgcccaagcaaaagtttgctgcagtggtggggtcctcatggagaacctcgctagggcaatgcagaagggaaatgtgaggtcagagcctccacacagactccctcctggggcactgcctagcaaagctgtgaaaagagagccaccatcctccagggcccagaatggtagatctactgacaacttgcgctgtgcacctggaaaagccacagacactcaatgccagcccatgaaagcagctgggagggaggatgtaccctgcaaagccacaggggtggagctgtccaagaccatgggaatccatctcttgcatcagcgtgacctggatgtgagacttggagtcataggagatcattttggaccttcaaaattagactgcctgctggattttggacttgcacgggcccaggaacccctttgttttgaccagtctctcccatttggaatgactctatttatctgatacctataccctcattgtatctagaaagtaactagcttgcttttgattttacaggctcataggtggaagagacttgccttgtctcaggtgagactttggactgtggacttttgggttaatgctgaaatgagttaagactttggggggttgttgggagggcatgattggttttgaaatgtgaggacagaaatttggaggggccaggggaagaatgatatggtttggctgtgtccccacccaaatctcaacttgaattgtatctcccagaattcccacatgttgtgggagggacccagggagaggtaattgaatcatggggaccggtatttcccatgctattctcatgataatgaataagtctcatgagatctgatgggtttatcaggggtttctgcttttgcttcttcctcatcttctcttgccgccaccatgtaagaagtgccttttgcctcctgccatgattctgaggcctccccagccatgtggaactgtaagtccaattaagcctttttcttcccagtcttgggtatgttttttcagcagtgtgaaaacagactaatatatctgtttacatagaaaaaatctgcaaggcaaaatcctttgacagagtatccgtctttgtggatagaaaattgtagcattttaaagaatcaagtttaaaatacacaagtacactaagcgttaagtgtttgtggacagggatgacctgcttttgcacatcaccaaaccttatgttccagtgtggggggtggacaataaatgtttgaagtctctatgggacagaggagttccagaatgcatgtgccacagtgggctgagacatcaccctctgcataccgaatcacctcagtcccccaatctcctctcggatgccatgactgacagcagtaaataagctctcgccgttggaaaactggagtgaaagtttcattctaaaagaagaattttaatgcactgtgactcagctgcccattcctgttgttttgctgctgtaaacattgcaacacatggattgtgcagggtagaagtgaactgtattattacttattaacttttgcttgcaattctcgtctaatatttattatgccctctgttcatgtttgttggtgttttttaaagtctgatggttaaatgtagcagtttttaaggaaaatatactaaatggaagagcagtattcataggcttatacctgtgaataattctgattaaagctaattacaaccttctgagtcatttcatgattcagcattaatatgattaaggatgcaccaaaaagtaacaatcaaagttacttgttgatgagttttaggtggtctggtaattcaagttggcctagtctgttatatgttgagtgtcatcttacaaatacagcagtggctccaaaaaattggaaaagaacctacctacaaatcacagccatttaatagtaaaagtgctgatgttttttaaatgactattggaaattccaaacagggaaagctctcgcaagaaaaaaaaagaaagaaagaaagaatgaaaagaaaagataatcacattcagtggaaaggcttacagcaacttatttactagctggactaattgctcaaaaaaggaaaagtcacaccattggtgagaatctcattaggccagcatgtaaaattacagtgagtaaaacgacaagataagatgcagtataagaagttgacaaggttccactttcaacagtatagctcaacatagtgatgacatgtcacatgatgtggaagaggattggaatatgctaccccaaaatatgccactgtggcatatgaattattttgagctgaaggcatttgagaattagcagatgcaaagagaaccttcctggggctttccctatctgactaaaagcagaaatgcctgagaaatgagaactgccataaatctcctctcccagggacattttatgaccatgaagaaaacagaaagttggcaccaagatggacctgcacaaaccaaccttactaaattaacccttatcttccattactttccccatatgtctatgatcccacagagggcagcccctagaagcttaaaacccttttcctgctggtgtggtggctatacctgtagtcacaactactcaggactgaggtgggaggattgcttgaagccaggagttccaggccaacctgggcaacatagcaagaccccatctctcttaaaaaaaagtcctttgtcttgtcacttttccacaatttattgctctttgttgaagatggtatataagctctcagatctatctgcttatttggctcttcacttcttttccaggaaggcccttatatataaagattaagatcaaataaaatttgtatgtcttttctcctgttaatctgtctttcatcagtctaatcttcagtgccccagacaatgaacctaaaggagcagaggaaaaagtttatattcctttcctgtgatgctgaagaattttgcgtaatgaactggaaaacaatagcttccttattcaggttgatgagtcaacagacgttaccaataaatatcactgggtagcactgggaagatctgtaagtaatgatgaatctcaagaaaccttcctgctgtaaaaattcacctcaaggccaagacacatttaaggttctgtcttcctacctggaaacaaaagctctgtcttggaggaaccatgctcacaatctggaccatagggtcccacgcatggatggttccataagaattttcacctcttggctgggtgtggtggctcacgtctataatcctagcactttgggaggccaaggcgggcagatcacctaagtcaggagtttgaaaccagcctgaccaacatggtgaaaacctgtctttactaaaaatacaaaaattagctgggcgtggtgacgggcgcctgtaatctcagctactctggaggctaaggaaggagaatcacttgaacctgggaggcagaaggtgcagtgagatgagattacaccactgcactccagcctgggtgacagagcaagactccatctcaaaaaaaaaaaaaaaaaaaaaaagaattttcacctcttgtaaagaaagaaaattctgacaaagtcacaacacactactttctttatagaaaggtattgaagtaaaaaactcttggaggtgaagtgaccaaagttctgagtgattctcaaacatgagaaactacattttaaaaagcccagttcacttgagtacgctttaaaaactaagaaaacctggacaaaggtacatgaatctcccagtacagagaaaccaggtggcttaacaaaggaagagttcgagctgaaaggtgacttgcaggaggactttcaagaaaatggaaagccagatttttcttagtgctttgaagataaagaatgtcagcagaaactagcctacttagcaaatactttatcacataaactagttgaacaagtatcttgcaggccccaggagaaaacgtgttgactccaagtaatgagattcttggatttaaaaggaaactgaatttttgaaaaaatcatgctgaaaaaatcttaaaatgcttccaatgtcgtttggccctatgagcaaggaaagacatcagtaagtctcacatcttattgaaaaccttctggaagaacttcaggacaaaatgaaagggcgttttctctccatttcaacaccaatgaccagcggagggacttttcctttaaacctactcagcttgagaacttgactttgagaggagagaaagaactttgtaaactgcagtctgatagtacattcaagatgagattcactgatctctccctaggcgagttctggatttctgtgaaagaagagtatcctgctattcgtatgcctaaaatgaaaattttgttacaatgttcaatttcttacttacgtaagcaaactttttccagtataacaagcatgaagaacacagacagaaattctcatttcaattgaaaaggaaatctgcaggtgcttagtccaaattcatcccaggatccagtatttgtgctaccaaaaataagcacaggtatccacttaaagaggcaaattttactctttattgttaatttcaaaagtaatattttacgcctaaacaggcctacaaaaaagatcaagaaacaataattttgtaggtgggagactagcctgactaacatggtgaaaccctgtctgtgctaaaaatacaaaattagccgggcatagtggcgcatgcctgtaatcccagctactcgggaggctgaggcaggagaattgcctgaacccagcaggcggaggttgcagtgagccgagatcgcgccactgcactccagcctgagaaacaagagccaaactccgtccctaaatagataaataaaataaaataaaaaattaaatcccaattttggcttaagccagttacttattttgtttcaaaattttatggaaaggaaagattcatctcaagaaaggaaagctaaatatagcggttttgtaaaaaggaagtttggctaaaagggaattgtttgttttaaataggaggaactactcttgcacatgtccatgtaacccttttattcgtaggcatttttattaagactttcacgcccacttggataaagtttttaaaaatcaaatatagaatttaaaagaaagaaaaacgtatttctcttatctataccactgataccctttaacatccttaatatcctttgtgaggaaggggaactatacagtcaaacagagccatggttcccagcccacggcattgccaaggagggtttgggctcccaatgaagggatcctttagccaccagggggcagcaccaggacacttatttctcagggaataatcaaaaagaaggaaaaagttaccttattcaacaagtatctattggacgtcgtatcgtatgtgccaaacacttaaggaatttacatttactggggcaatggaatggtgataacgggtatcaaaagcaaagttgcctacctccaattttacgaatacctcattagcattacctcttccaaacacccatgttgacctttcaacaaacatatttttcgcttctttctcatttctaggccctcttccttctttgaatcccacttttggatggataatagttcaggtgagcctctgatcatttcctaagtggaacaaaaaattgtcactactggccactcctctctcaaaattatagacactatgtcagacttttttcctaccaatgtcattatggaaatttcatttttccttctttttttttctcttggcctgaaaaacctaaattacttatcatctggtcctttacagaaaaagtttgtcaaccccttgatctaccccaccatcttctcttctttgcacaacaaaagattccaggccgtgtgtctgcttcttcaacctcctggcctcttttctcttcctcagacagtctttcccttcctcgggacttttatccttgctgcatcctttaactgcaatgcctttagaggctcattcctatcccttaaatctcatctccaacaccactatctagagtaaatatccccttctctagttactatgtcgtgaaatcacccctttatttccttcataattatctcacttattgtctatttccttcaccagaatggaagctccatgagctcaggcacctgactgtctttttcaacactgactagtacataacaggcactcaatattttttttaattgtggtaaaatatacataacaaaagttaccattttaagtatataattcagcagcgttacatacattcaaattgttgtgcaaccatcaccaccatccatctccggaactttttatcttcccaagctaaggctcttggcccattaaacaataacttctaattgcatccttccctgtccaccctggtgaccatcattctgcactctatgaatttggctactttatgtcccccaaataagtggaatcatacaataggtgtccttttgtgactggcttattttccttagcataatatcttcagggtttatccatgttatagcatgtaactgactttctctcctcttttatttatttattttttttgagatggatcctggctctgtcgcccaggctggagtgcagtggcacgatctcagctcactgcaacctccgcctcccgggtttaagcgattctcctgcctcagcctcccgagtagctgggattataggtgcctgccaccatgcccacctaatttttgtatttttagtagacacagggtttcaccatgttggccaggttggtcttgaacacctgacctcaggtgatccgcccgcctcggcctcccaaactgccttcctctttaagactgattaatattcctttttatgtacataccacattttgtttatccactcatctgttgatggacactgtaagactttcttagtatacacctataatcccagctacttgggaggctaaggcaggagaattgcttgaacccggaaggcagaggttgcagtgagctgagatcacactactgcactccagcccgggtgacagtgcaagactccgtctcaaaaaataataataatgataagaataagaataatcttggggcagggtgtggtggctcacgcctgtaatcccagcactttgggaggccaaggagggcggatcatttgagatcaggagttcgagaccagcgtggccaacatggtgaacctctgtctctactaaaaatgcaaaaattagctgggcatagtggcacatgcctgtaatcacagctactcgggaggctgaggcaggagaatcgcttgaacccgaaaggtggaggttgcagtgagctgagatcaagccactgcactccagcctaggcaatagagcgagactcttgtctcaaaaaaaaaaaaaaatcttggccaggtgcagtggctcacacctgtaatctcactttgggattagcactttgggaggctgacctaggaggcttgtgtgagcccaggagtttgagaccagcctaggcaacctagtgggaccctatctctacaaaaaaaaaaaaaaaaaaaaaaaaaaaaaagctttttttaattagccggtgttctacaagggtgtaccaacaataaacagaaaataaagaatacataaaataaataaatagataaattagctgggtgcagtggcacgtacctgtggtcccaactactcaggagactgaggagggaggattgcctgagcccaagagatggaggctacagtgaaccatgatgacaccactgcactctggcctgggagaaggagtaagaccctgtttcaaaataataataataacaaatatcttatcaattgtcaacattccctggggcttttaaatgccatttggcttaactgagttttacaattacaataaacgttcagttagtatatgcttaatttcttaattttcacgcctgtaatcccagcactttgggaggccgaggtgggcggatcatttgaggtcaggagttcgagaccagcctggctaacatggtgaaactctgtctctactacaaatgcaaaatacctactcactagcaaaacaaagggagtaataacaaataccaggtacattacatatcttaatgagagagtctttaaaagcatttgggtgggcagcttttttttttaactttgaaattatggagtatatcaaatatacatatataatataatacatcaaatcctcatataatcatcacccagcttaacaactatcagctcactgtgaagcaaatcacgtcatgttgtctgtatttcaaatgccttcctgacagattagtaaatggtttgaatgtcttagcattttatgaagaagattttttcagctgaatttggtatcagattcctatctgcaaatctgtcatataatatggtagaaagcatttcattaatacaaatttcaaattgaatattttagaaggatttttacatgcctgattatttcaagaatgcaaattttgaaggaaaatatttgtcaacaattagtcactaagaaagataaaaattgttggactacaaggtgactatacttctttcagtaactggtgggggctcagagactacgtccatggctctccacttggtgaaagaatcacagggaactcagtttgcttgtttgtttttgagacagagtcacagggaactcagtttgcttgtttgtttttgagacagagtctccttctgtcacccaggctggagtgcagccgctttctgggctcaaacgaatctcccacctcagcctcctgagtagctagcactacaggtgcacaccacacatggctaatctttggattttttttgtagagatggggtttcaccatgttgcctgggctggtctcgaactcccgggcttaagcaatcttcctgcctcagcctcccaaagtgctgggattacaggcatgagccaccatgccaggcccggaaagaacttgtttaaaacgtaggttccggggcctcatttttggagatttcaggttaggtctaggctgaggtccagaaacatgcacttctagtaagtgccgacggtgattctgatggaggtggtctgagaccccattaagggcaacactggctgaaaacccttttgctaagtttggcagtaatttgctccctggctttggccatttaaaatttggccttttagtattctcttcagtgaagattttcatgtaccaaccagataaatataccataacccagcacagcctttctttccattctctgctttgaatgatgcacactcttcccacagctttcatgatcatatattgtctcacttgtgagtatgattcgttttcatggtctttgtaaattctgatttgatttctttgtcggtttccaggagcaacgaacggtaacattaaaattagatggcattggcctgagcaatttataatatagtgaatatttaatactactgaggatgaggaaaaatgtaagaaaagattatccattttggtaatagtcatttcttttgcatcagcttgtttactgttggaacacaaaaacaatttgcctgaatcttcttaatttaaaaacaggccaggtgcggtggctctcacctgtaatcccagcactttgggaggccaaggcaggcggatcatgaggtcaggagatggagaccacctggctaacacagtgaaaccctgtctctactaaaaatacaaaaaattagccaggtgtggtggcccgcacctgtaatcccagctgctcaggagactgaggcaggagaatcccttgaacctgggaggcagaggttgcagtgagctgagattatgccactgcactccagcctggctgacagagcaagacttcatctcaaaacaaaagcaaaaacaaaaacaaaagcaaacaaacaaacaaaaaaacccagaacctaaatcagcaatgctttttattaattaacagcaactaatagcaatcaacagcaatcttcttagaaaataattttatgctaccaactaaagttccaatttcacagcaatagagctaaagctaaagggaaaacctcaggaataagtggcctgaacatgaggaaaatgtaatagaagaaagcaaagaataagaggaaactggatctgagttatttatcgaagcacattaaagaacaaccataggccggacgtggtggctcacgcctgcagtcccaacacttccagaggccgaggcaggtggatcacctaaggtcaggagttccagacctgcctggccaacatggcgaaaccccgtctctactaaaaatacaaaatgtaaaaatacaaaagttagccaggcatggtgacaagcacctatagtcccagctactcaggaggctgaggcaggagaattgcttgaacccaggaggcggaggttgcagtgagccgagatcgtggcattgcactccagcctgggtgacgagagagagagactctgtctcaaaaaaaaaaaaaaaaaaaaagccataaatataagaagctcagaattggcaccccaaaatatgccactttgctaaagcattattttaaactgaaagcaactgtgaaatagcaggtgcaggaaacactctctgtcctccccttttctacctaaaagcagggcacaagtttccctttgtgaaagtatcccccactcttgtaccaggaagggaaaaacagcctttatctctggagatggaggtgtaccgggatgcggctgcgggaattaaccttatcttcccatgagtttcccccatattttaccttcccagaatttgccaccctagaagctccactgccctctccttggtcttatcacttctctacgttttgttgccctttttaagatggtatttaagtgccccgagtttaaccacttctttgggtctttacttcgtatgaacgcttttgagcacataaaaaacaattaaaatattaacatcaaatacgtttgtatgcctttgtcttttgccagtttaattcacaggctccagtcactgagcttaagagaacacaggaaagtttttcctcccctacaatattatttgggaacttaatccactgggcatttgctcacagccttccctccctccctcccttccgttccgttccctcccttcctccctccctccttccttctctccctcttttccttctttccttccttccttcctttccttccttccttccctcctttcttttccctctcgtctcctctcctctacttttctcttctcttctcttttttctttccttttctttcccaagatcttgctgtgtcacccaggctgcagtgcagtgcaatcagagctcactgcagcttcaatctccctggcttaagcaatccttctgcctcagcctcccgagtagctgggactacacatacatgtcaccatgcccggctaatttttttttttaaattttttgtagagatgggggtcccactatgttgctcaggctagtctcaaactcctgagctcaaacaatcctcctgcctcagcctctcaaaatgctgggattacaggcgtgagctattgcccccaaccacagttttcttttaactatgaagggatactggcgtaggagaaagaactttgaagttagacaaacctggattgaaatctcgaacctattagttagtgcaagttatttaaatctgtgcctcaatttctgcatctataaaacaaagatgagacctatttaatctaacagctattgaaggttcaataaaatgaaacatgtaaaatacttagcacaaagtagaagactggtaacatttagtccctgaattctgatatgtaactctgtggctaagattgctagaaagagatgcatttagagagctggatggataaaatgtaagtcctgcgtttttctcttttcttttaggtggggctgtcatagctatatgcaggggtcccattgtgctagctggcaggctttgcacaagattttgcagctgaaagaggaatttgagaaaaatacaagatcccaatgagtataaaataaaagcacagaaggacacaattaccattgtggatactgccaaatgattcacagggcagcaagtgggaagggaaggagcagaatctgcccgattcttaatatgtagcaagagcttctacccaataattctgctttaaggggcctctgttaaggaaataatcctaaatacataaaaacaagcacataggtggtcatgagatattatttagccattataaataatacaacttagtatatacattatcaactcaattatgttttctgaaaaggatactgatgaacaaagactagaaagaaatacaaaacagtactataagtacttaatttttgtatggtgaattatgactgtggaatttcaatattcattttagttcctattttgaaaatttctacccttaacaatgtcatttttataatctctctacccccaaaaaaaacccacaacaaaaaaatgatcaccataatacaaaagtttttcaaaaaataaatgcatggaaattatctgtattgattaaaaaaagatccaatcacttcaggtttcagatttgtaggtggcaagatgaaaatttctttctttttttttgagacagagtttcgctcttgtctcccgggctggagagcaatggcacgatcttggctcactgcaacctccacctcctgggttcaagcgattctcctgccgcagcctccccagtagccaggattacaggcatacaccaccacgccccgctaatttttgtatttttagtacagacagcgtttcaccatgttggccaggatggtctcgaactcctgacctcaggtaatccactcgcctcggcctcccaaagtgctgggattacaggtgtgagctaccgcacccggccggaaatttctttatgcaaattaaagggcctgaaatttgtgtttcctatagggtggaaggcctccatggctccacatggaagaagactgcagagggatcgcaaaagagagtcaacatcttttttttttttttttttgagacagtcgctctgttgcccaagctggagtgcagtggcatgatcttggctcactgcaacctccgtctcctgggttcaaatgattctcatacctcagcctcccaagtagctgggaatacaggcatgtgccgccatggctggctaattcttgtatttttagtagagatggggtttcgccatgttggccaggctggtcttgaactcctaggctcaagggatccaccttccttggcctcccaaagtactgggattacaggcgtgagccaccgcacccagccatactttcaatagtaggtttagatctattgtattgagcaaaaaaagttctcaactacagcctcgacattttgtacttgacaggtgtggtggctcacacctgtaatcccagcactttgggaagctgaagagggaggatggattgaggccaggagtttgagactcgcctgggcaacatagtgaagcccccatctcaacataaaatttaaaaattctgcacgtgtggtggcctgtgcctctagtcctagctacttggaaggctaaggcaaaagattgcttgagcccaggagttgggggctgcagtgagctatgattgccccactgcattccagcctgggcatcagagacagaccctgtaacaaataaaaatataaaaattctataccttacagcatggtagagaaaaccatggcttggactttgaggactattgtttgttttttgggacagagtctcactctgtcacccagactagagtgcagtggcacgctcatggctcactgtagccttaacctcctgggctcaagtgatcttcccacctcaacctcctgagtaggtgggactacagctgcaagctaccattcctggctaattttattgtattttttgtggaaacagagtttcgccatgttgcccagactggtctcgaactcctgggctcaagcagtctgcctgagtcagcctcctaaagtggtagattacaggcaagagccaccgcgtctggccctattgttactaatactccacattaccataaaaagactttgatatgactattagagaatgattcttaaacaggactgtgttcatatggttgatcattagggatttaaatctgaaaactaaaatgacttctcattccttgggcctggcaggagtttaaaagtgtttctatagtaaatgcttttgtccttcaaaggcctctactaggaatctatgggtgtatttcccatgactgagacaatgtattttcctcttgctgacatttccaccactaataggattttccatggcccactccacatggacatttttctcatggagtcccattgtgcctcttggtcaggattttaaatggctcccgactctggggccttcatgtgatctgcaggaaatactcaagcaacattgggcctaacaaactcaggaatgtaggctgatcccaaaatatcgacgaccccttcttcgtgcctgccttttcaggagctagtcatctcttctttgtctttcttgatttctaggtgagattcggttaatgcactgtctttttaattacaggtgaacatattagattttctgaaaggtcccactaagtcctcccctcccaacctgaggttttctgccccctctttcgctggaggactccaccgcacagccatctctatagtcatcttccctatctatttaccttttaaaatacttaatggagactaggggctcaagacgcatctattggccaggctctgtggttcatgctgggtccggaattggtgggttcttggtctcactgccttcaaaaatgaagccgcagatcctctcggtgagtgttacagttcttaaggtggcacgtctggagtttgttccttctgacgttcagatgtgttcggagtttctttcttctggtgggttcgtggtctcactggctcaggagtgaagctgcagaccttcgcagtgagtgttacagctcttaaggcagcgcgtctggagttgttagttcctcccggtgggctcgtggtctcactggcttcaggagtgaagctgcagaccttcgcggtgagtgttacagctcataaaagcagtatagacccaaagagtgcacagtagcaagagttattgcaaagagcgaaagaacaaagcctacacagtgtggaagcggaccccagcgggttgccaatgctggttcgggcagcctgcttttattctcttatctggccccacccacgtcctgctgattggtagagccgagtggtctgttttgtcagggcactgattggtgcatttacaatccctgcgctagacacaaaggttctccacgtccccaccagattagttagatacagagtgtctacacaaaggttctccaaggccccaccagagtagctagatacagagtgtcgtttggtgcactcacaaaccctgagctagacacagggtgccgattggtgtgtttacaaaccttgagctagatacagagtgccgattggtgtatttacaatccctgagctagacataaagattctccagtccccaccagactcaggagcccagctggcttcacccagtggatcccccaccggggctgcaggtggagctgcctgtcagtcccgggtccgtgcgcctgcagcactcctcagcccttgggtggtcgatgggactgggtgccctggagcagggggtggagctcgtcagggaggctcgggctgcacaggagcccatggagggggtgggaggctcaggcatggcgggctgcaggtcccgagccctgccccgcaggaaggcagctaagactcggtgagaaatcgagcgcagcgccggtgggctggcactgctgggggacccagtacaccctccgcagccgctggcccgggtgctaagcccctcattgcccggggccggcagggccaagcccacgcccacccggaactccagctggcccgcaagcgcggcgcgcagccccggttcccgctcgggcctctccctccacacctccctgcaagctgagggagcgggctccggccttggccagcccagaaaggggctcccacagtgcagtggtgggctgaagggctcctcaagtgccgccaaagtgggagcccaggcagaggaggcgccgagagcaagcgaggattgtgaggacttgccagcacgctgtcacctctcaatgcctgtaatcctagcattttaggaggccggagtacgcagataacttgaggtcaggagttcgagaccagcctgaccaacatggtgaaaccccgtctctactaaaaatacaaaaaaatagcgccccagaagagcctcgtcctgggcagcggtggcgcggcggtcgctgtgatagccacggggctgggcggctgaccgctgggctaggagagggcccagcgccccgaatcttggtggccgctgctggagcgcggcctgcgccatggccacctccgccgcctcctccgagcgtttcaagaagctgcacgaaatcttccgcggcctccacgaagacctacaaggggtgcccgagcagctgctggggacggcggggaccgaagagaataagtcgatcagggattttgatgaaaagcaacaggaagcaaatgaaatgctggcagggatggaggaggagctacgttatgcacccctgtctttccataacaccatgacgtctaagcttcgaaactaccggaaggaccttgccaaactccatcgggaggtgagaagcacgcctttgacagccacaccaggagggcgaggagacatgaaatatgacatatatgctgtagagaatgagcatatgaatcggctacagtctcaaagggcaatgcttctgcaaggtcctgaaaacctgaaccgggccacccaaagtattgaacgttctcatcagattgccacggagactgaccagattggctcagaaaccatagaagagctgggggaacaacgagaccatttagaacgcaccaagagtagactgataaacacaactgaaaacttgagcaaaagtcgaaagattctccgttcaatgtccagaaaagtgacaaccaacaagctgctgttttccatcatcatcttactggagctcgccgtcctgggaggcctggtttactacagattctttcgcaaccattgaacttcctgtagggaagggtttgtggaccagaactttcaccttgtgaatgcatgaggttagggatgtggatggaataagcatattgctgctgagggctaacagttcaggcatgcactgtgtaaccaggctgtgggaggaggcaggaaagatggaaagccacttaaatgtgaaggaacagcaagaagaccagtatgatataccaaggtaataaatgctgtttatgacttcttttaaaaaaatacaaaaactagctgggcaaggtggcacaggcctgtaagcccaactacgtgggaggctgaggcaggagaatcacttgaacccaggaggtggaggttgcagtgagccgagatcgcaccactgcactccagcctgggtgacacagcaagactctgtttcaaaataaaaaataaaaaaaagacgcatgcacctatgctaaggtttttgcatgatggtttatttggaaataacatacacagactcattgcctctactgaaattttgacaggaagggtcccaactaacatcctataacatccataaacgcctgcatatgcgcagcaaatctctggcttcttttgggaagaaactggctcttcctctgggaagagaagctgcgggggctgaggtcaggggcagaactatatttattttattgatatccctttttactgtttgcatgtactatgcgcacgtactacttcaaaaaaattcaaataaattaaagagaaaaatatataaataaggagaagataacttctgcataaatggatattaatatcatgctcttggttgggacaatttgtcattgtagaattgttcagtcctccaaagttaatctataaatgtggtgcaatactaataaagatcctatcaagatttttttgcaacaatttgacaaataaatgaataaataaacctctacacactagctaatataatcgaaaaagaattatctatattattatatgtataagaattatataaataattgaaaaagaaaagagaaaagaattgcctatcaatataaagacacagtatccagccaacaaaattttaaatttctgtattttgggtagtgggcatagagaaagagcaagggaatggagagagtcaaggcacagagccaggaatggtacagaacggaatgtgggctaggagcagtggctcacacctataatcccagcactttgggaggccaaggcaggaggatcacttgaggtcaggagttcgagaccagccttgccaacatggtgaaaccctgtctctcctaaaaatacaaaaattagccgggcgtggtggcacgtgcccgtagtcccagctgcttgggaagctgaggcatgaaaattgcttaaacctgggaggcggagattgcagtgagccgagatcatgccactgcactccagcttgggtgacagagcaagactctgtttggaaaaaaaaaaaaaaaagaatggagtatgcacgatagctgaatcacctgggggtggcatgacaaatcctaggggaaatggtcatttagtgaaaatggaaaaatggcttgcttcatggaagagaaaataaattatgtctctactatatacaacttataaaaaataaaccttaattaggttagaagtgtgaaagataaaaacagtatatatatgtatttatttacatttgttttgagagggagtcttgctctgtcacccaggctggagtgtgatggtgccatcttgactcactgcaacctctgcctcccaggctcaagcattctcatgaatcagcgtcgggagtagctaggattacagacacccaccaccccacccagctaatttttgtatttttagtagacagcgtttcaccatgttccaggctggtctcaaactcctgacctcaagtgatcttctggtgagattgagaatctctttaagaaaattcctactcatagcctttgactattttcctttagggtttcctgttttatcttgctgattatcagaagttttttttttgagacagtctcactctgttgcccaggctggagtgcagcggcgcgatctcggttcactgcaacctccgcctccctggttcaagcgattctcatgcatcagcctcctgagtagctgggattacaggtgcccgccaccatgcagggctaatttttgtatttttagtagaatggggtttcaccatgttggccaggctgctctcaaactcctgacctcaggtgatccacctgcctcggcctctcaaagtgttgggattacaggcgtgagccactgtgctcggcctgcagaagttctttgtagctatttatccctttattgcttttatatgttgtatttctttccagtctgttacccatgtgttaacatggtctattctatctttctttgaacaaaactatttaattttggtgtactcttattcatttatgaattgaggatcttgtttaagaatcttttccactctgatgttttaaaaatatttttcttgtttaacaattggttttggctgggcatggtggctcacacctgtaatcccagcactgtgggaggccagagcagaagcatcgcttgagcccaggagtttgagaccagcttgggcaacacagtgagacttcatctttatttaaaaaaaaaaaaaaaaaattggccgggcggggtggctcatgtctgtaattctagcattttgggaagtcgagacgggtggatcacctgaggtcaggagttcaaaaccagcctggccaatgtggtgaaaccccatccctactaaaaatacaaaagttagctgggcttggtgatgggtgcctgtaattccagctacttggaaggatgaggcaggagaatcacttgaacctgggaggcagaggttgcagtgagccgtgatcatgccattgcactccagcctggatgacaagagtgaaactccatctcaaaaaaattaaaaataaaaatataaaaataaaagatccttttaggccacggacagtggttcatgcctgtaatcccagcaatctgggaggccgaggcaggaagatcacttgaacccaggagtttgagaccagcctgggcaacatagggggacatcatctgtatcaaaaatagaggttaatctagtgtggtggcacacatctgtggtcccagctacccaggaggctgaggcaggaagatggtttgagcctgggaggtcgaggctgcagtgagctgtgatcagaccactgcactccagcctgggcgacagagtgagaacctgcctcaaaaaaaaaaaaaaaaaaaaagaaaaaaaaaaaaaaaaaaaagatttttttaatttgtacaggataatggaaggacttttattggaaaccagaagacctggctccactattcagtagctatctgacctccatgttagaatctggcctctgtaagcctatttcttcatctgtgaaaagccgcctacctcagtgtcagtgtaaagaacaaatcaaaaatactcagtgaaatgtagtgttataaacaaaaacctaaagatttattaaaactcttctttagctctcctaatcattttcttaaatggatttataaaactcaattcacacaaaactttaaagggaaacgtgctatttaagaaaaaaatgtgtcttggtcagttactttcaaacaacgtaggaggtggaatgtgtatattagaagattctggggaatttaaagatactaaggaatgacagttggctataagccagcctttatttgctctttagaataaactcagtacttccctcagagagaaatgttcatcgtttcaggacaagtgttatttatcacattacaaagaaactcgaatatgtaaaatttttaatgtatgttacattattttaaccagcaaaaaaaaaaaaaatggaaatctaactttgcacataaaaatgattcaattatcaaaaaaggacatcctatttcaaattcaccataaacatttttggctgggcgcggtggctcacgcctgtaatcccagcactttgagaggctgaggcaggcggatcacgaggtcaggagatcgagaccatcctggctaacacggtgaaaccccgtctctactaaaaatacaaaataaataaataaataaataaataaacaaaattagccaggtgtggtggcaggcacctgcagtaccagctacttgggaggctgaggcaggagaatgcatgaatccaggaggcgaagcttgcagtgagctgagatcatgccactgcactccagcctggacaacagagcaagactcatctcaaaaaaaaaaaattatagttcattcttctgcaggtgttgagtgcagttaggtgagttaggtcaaggtgactgatggttttgttcagctcttatgtccttactgattttttaaacatgttctatcacttcctgaagaagagatgtttaattctgtcaaattttgcttcaagtattttgaagtgctgttaagtacatacccacttacaattatctttctaatgtagtgactgttttattatgaaatgtccagactgggcacggtggctcatgcctgtaatcccagcactttgggagacggaggtgggcagatcacctgaggtcaggaattcacaaccagcctggccatcatggcgaaaccctgtctctactaaaaacacaaaaatcagccggatatggtggcagatgcctgtaatcccagctactcaggtggctgaggcaggagaattgctagaacccgggaggcagaggctgcagcgagctgagatcacaccactgcactccagccttggcgacagagcgagactctatctcaaaaaaaataagtcccttttttccctgataattctctttgtctggaaatctacattatgtgataaatagccactccaaccttcttatgcttatattttgtgcctatcgttttccatccatttactctcaacctatctgtttttatatttaaatatcatcgatagacagcatataattgccttactttttaatgcattctgacaatccttgcattttaattggagtttttagtttattcaaatgtaatgtaattattgctatggacgaatttaggaaaacctctttgagttgcttttttgtggttgcccaagggatgacaataaccaaccttaacttttcatagtgtttttaaagttaatattgtgccacatgacataaaaatacaagccccttgcactctacctgtactttaagctatagctgtcaaatgcatcacatttccatgttataaatttcattacagggtttgttataatttttgctttgaacagtcccgtattttaaagaaattatgaggaaaaggagtcttttatacttacccacatatttacctttctgagcctcttccttccttcctgaacattcaggtttccatctggtattatttcccttctgtctaaagaacttcatttagcatttcttgtagcacaggtctgctagtgacagattctacgttttaagtaaaaatgtatttaatttgccctcattattgcatgatattttcatttcatctgtatgattatttccagataaagggttgattttttttttcagaactttaaatatgtcatttcacttgattctgatgagtagtcaatggcatttcaaatctttgttcccctcataaaatgtcattttcctttggttactctaaagatattctttttattttttccttttcaatggtttggctctgttttgtttttgtttgttttttgtttttgtttctgagatggaagtcttgctatgttgtccaggctggtctcaaactcctgggctcaagtgatcctcccacctcagcctcctgagtagctgggactacaggtgcacgccactgtacccagcctcatttttgaaatttaaatacaaaaagtgagcactggctttttaaaaacatacacacaggccgggcatggtggctcacacctgtaatccgagcactttgggaggcagaggtgggtgaatcacctgaggccaggagtttgaggccagcctggccaacatggcaaaaccccatctctactaaaaatacaaaaaattagctgagcatggtggtgggtgcctgtaatcccagttacttgggagtctgaggcaggagaactgcttgaacctgggaggtggaggttgcagtgagccgagattgcgccactgtactccagcctgggcgagggagcgagactctgtctcaaaaaacaaataaaacatacgtacaagtctaacagccaaaatgcacagaggaaatgatctcctactctgtcctccaaggttcccattctgtggctgaatttgctgctggccttcctcctttacaacatgcatagaaatccacagcatccactttacactacagctgtaatgcattttgtctgcttcatgccatgtgcacatccttcctcattctgattgatggtcaaggatacatccctccactagcatcagttcctgccctacgatgggatagcgaggagatcaaccagttaggaaaaatctagtcaaaggggtagggtggctagagatggagtagccctctgcactgatgtactgtggtatctgagtgaggagagaaaaaatggggcagaaaagcatggagggcacagttgaaagttgggagtctctctgtgaaacgctgtgaggaggattcttctgacctgctttagatagatcaatgtgccaaagtaaagaaaaaaaatccggccgggcatggtggctcatgcttgtaatcccagcactttgggaggccgaggcgggcggatcacgaggtcaggagatcgagaccatcctggctaacacggtgaaaccccatctctactaaaaatacaaaaaaattagccgggcgtggtggcgggcgcctgtagtttcagctactcgggaggctgaggcaggagaatggcgtgaacctgggaggcggagcttgcagtgagccgagattgcgccactgcactccagcctgggcgacagagcgagactccgtctcaaaaaaagaaaaaaagtccaaataatcagcagtctagagacttgaatttcaaacttctcccaccaggatggctcatatatggcagtaacaatctagatctctccaggagtgaagggagagcctgtggtaggccccgtggtaggccctagaaagtatccactgctgcttctagttgctgctgttgttccacttgtgacttagtctccaagacaacagaacagccaggagtataaagaaagtggttgcaatccacaaggctgttctggaaaacccgtatatcttttgagccatgaagagggagagatcagaaatggatccagctacagaccagagttctttgggagcatctccatttggcgccattgtcatgatgggtctcatttagctccttgtggctcctattccaccccctcctcagtctcctctatgttgccttttgggcgcaatttggggacaggggtacccccgtgccatggcagcagcaaataatgggcatccattttctctttcctttctggaaccctatacacgttagatctttttgtattgtcctgtctcttaggcaccattccttattttatttttctctctgatcttcagattgaattaatttctattgctttaccttcaaattcacagatactttcttacgttatttctattctgatcttttttttcttttgagacagagtttcctcttgttgcccaggcttgagtgcaatggagtgatctctgctcactgcaacctccacctcctgggctcaagcgattctcctgcctcagcctcctgagtggctgggattataggtatgcgccaccacatccagctaattttgtatttttagtagagaccgggtttctccatgttggtaaggcttgtctcaaactcccaacctcaggtgatcgacctgcctccacctcccaaagtgctgggattacagatgtgagccaccacacctggcctctattctgatcttaaggctatccagcaaaaatttcattttaaatattatattttcaatgttagcattaacctttggttcttttttatggtttttctcttctgtgatttcctatcttttcattcattatgagtatattttcctctaaatccttgggcatagttttgacagctgctctaaaatttttgtctctaattccaacatctggttcatcctgggataactgatcgactttgagtcacattttcttattttttcgtatgcctagtaattttagattctaacctggacacttggatgaactcaaacttctcagttcagttatttaaggcttatatgggctgcttggagtctgctgtgcacatgtgtagtttaggttcggcaagaaatttgggcattttctatatagtctttaaggctcctcctttgtgaatctctcttttctgtgatttctcctctacttcccattgctgtgcgtttgcatccctcctcctcgcctctttggtgagggagggatttctactgtaaggctatgggaataagctaaacacaacacaagacactacacagatgagactgacagcagtgtactagtcacatatactcacagcctagcagagaacacccactccacacggggccaggtggggcctgcacttggaaatagagaacaaccacgggtgcaggctttgtagtatcaagaggatgaggtcgctcctggttcctgagggaggacgtgactggtgtggatgaataattccataagctgtcagggaactaaaacctgtgactcaggaataagcaggaaatgtgcctgatccttgagctaaggagtggagtgtggacaggaacttgtagttaggccattcaagggcctcctgattttaccagatatcaaggcaatacatggtattaactttagaccatacaccacctgtggttgtcctggactccaacctctggctcttcaagccagtaagtctgcaagtttgaaagttatagtcattccacatggtactgatgagggcctgcccccaggctaaatgacattcttatatgatgaaactcatgaactgctatttccttcttccaagtgtggactcccatccagaatttgccttctttttcttgctctccagtgccttttggtagatttttaaattctgttcagaatgtatagctgttatttgcaggaacactgatctgacaggagctatctggccattacaggaagcagaaccttcaaagttccttcttaatcttggctgcttagagtctgccctgcacatgtgtagttcaggtaaactgctttggacacgagcagcttaaccacacaactgaaggaattatcaggtgtgactaattataacaggacttggcatggagtctctgggataataacacatgagaacattatcccacagctgaaatccgtaactggagggctcataaaaaattgttgcataaaacacttaaattttgatttagtacaaatttagattccgtacaaataattcatcaaacttgagttgagcctggaatatatcagataaaatccaagaaaaaagttttttgttttacagtttttacatactgctaaagtacatatgggggaaaattatggctatcatttgataatgcagtcctatatctcttcttaaatacctaccatctttcattagccttgcttgatttttaccaattttaatctctctttaattctgccatcattgccaatttgcttttatttatacttatgcttataagcatttccctaacatgtgtcatgtccctataaagactataaatgtctcatggacaaagaccaaagccttgatttcatttaaacctcgacactgcagatactcacatatgttgattattctttttcagtgaatcctatcaagactcagatggacaaattgggcttttaaaaaaatctcttcagtactaggtatatggttgtttcctttggtgatcccagaaggcctcacaagactcaatagcaggttatatattaatacgtggctcagattaatgacagcaaaggatacagggcaaaagcaacaggaaaagatgtatcagtggagtccagagaggtccaacataggattctgttgtcctttgtctgcagctacacaggaattctgtctctctctcagcaaactatagacacgtgtggaatgtctctgcccacagaatcccacttgagtctcagggtttaaggcttttgtgggaggctgttcatgtactcatactctgctatggaattggctacggcaaccaaaactcaggggcccaataataaaaccaggtgcctatttatcagtcttggtgtttgtgcaacgcaacctggcgagccagtatggaatggtccaatgctccaggtgtatacaacaaaatcatcatcactaacataaagaacactccaaggattgcaatccaggggttggccaaggtcaaagatggttcccctggagacatgcaaggggtaagcatccagaactgctacagtaactcttttcctcacaaggccctgcacatccttgcttatcacctagtactaattcctggcttactaataggaataatacaaagctaattaagtctgggcacgtgagaagatatttaaacctattttattgctaaatcattccctctagtctctctaccctacccaacatattctagcctccaatttctatcctggtagataacattacatttgcattttgttattccagaaggtgcataaagttctttgtttttttcttctcttttcttttttttgagatggagtcttgctctgtcgccaggctggagggaaatggcatgatctcggctcactgcaacctccgcctcccgagttcaagcgactcccctgcctcagcctttatgaacaggcaacatgtaggcagcagtagtttatgctgcttagaagagaaggcctaagaaggatagagctcaaagttgtaaaatctacagggttcatatccttgtatgatttacatttgtatcatttcccccacacacctgcgttacctcctggattttctatttcgtacagccttaacaagatctacctgtggcccaagccaaaaccctagatgatacctcttctctcccatcctctaaatacagacactaaacccaattgatattagctcttaaagacgccctgatctatttccttctttccatatgacatcattttcctcttaactgctcctttctcttgcttctctccccctctcccccaggccattattcatgtcagcagggttctccctcccgttctttcctagaaagccaatgcaccacacactgaagaataattttctgaaaaagatgtcttaagtaatgaggtattattaccacttatctctattttcgattgtttcctgtatgtcatagatctactaatatctattttactggaaaacaaattaattatatctcaaattgaaaaaatatgtcctcaggatagaatcaattgcttggagttctctgagccaaagtgcaacagaaataataagagctgcttcctgtgcctcatcctctctttgctttacgacatctggagtcttctcccaatctttctttctcaactgctatgttcagattcctcttcattaaatatttctgccagatttcattcctacagaaaagcccacagtcagaaaaggattccttggctagttaatatttcataggtcccttccgagggtgtaggcagatgttatagacggtgttaacatataacatcaatctaaatttgaattttaaaacatctgattcataaaagtgataagaattgttccatctgaacctaaaatactcaagtgagatcctgcaaaaattgttaaagctcttagcagcaagttgagggctatactgaatgagaagagggctacctacaacttctcttaaactgctaaaaatttttcacaaaaaatgtgtttctaagccaaaactgcctagattaattcctaaagtgagaagtcttcagaagcttcaaatttaccaactgtggtacttctttgctttaatttgtgtaataatttatgtgttattagaatgctggtatacaaagatcagacatgactaataagtaaaaaaaattatcataaaagtgaactaaatccaaatatttggtgtatctacttatctactcttttcctggtagataatattacatttgcattttgttattctagaaagtgcataacgttctttgtttcttttcctttttttttgagacggagtctcgctctgtcaccaggctggagtgcaatggcacgatctcggctcactgcaacctctgcctcccgggttcaagcgattcccctgcctcagccttccaaatagctgggactacaggcacgcgcacatcacgcaattttttgtattttttttagtagagatggggtttcaccatgttggccaggatggtctcgatctcctgacctcgtgatccacctgccttggcctcccaaagtgctgggattacaggcatgagccaccgcacccacccagttctttgtttcttttatattttagatgaagcatagatttttgttaaaataatacatataccaaaaaaagaaaaacaaatgtgcaaaaggataaatgaagcctctagatattgccggactatttttccagagatatttaatctgaatacaaagttaacattgtttaggatatcctaaatgtaatatcatataaggaagtcacttggctttttgaagttattttttaatcaacataccaattatcaagtcaaagactaggttagatatgctattgctctaaccctgtattacaactatatatacacacacacacacatacacacatatatatatgcacacacatacacacacacacacacttttttttttttttttttgagacagtctctcactctgtcacccaggctggaatgcagtggcgcgatctcagctcactgcaagctctgccttgtgggctcaagcaattctcctgccttagcctcctgagtagctgggattataggtgcctgccactgcacccagccaatttttgtattttagtagaggtgaggtttcatcatgttggccaggctggtctcaaactcctgacctcaagtgatccgcctgccttggcctcccaaagtgctgggattacaggtgtgagccactgcacctggccagcaactatattttttgttatttaaaaaaagtatcacaaatagtctccataaataaaatttgtatatctcagtccctaaattttaattttaatgttctaccatcatcagtaatggctcaaatagtcatttctttctctgattcttctatttccccttaatatatagctttttagcttctaatacttcccatataattttcccccatatattttatatctttgtttttaatctaattttcgtacttactttagccagataccagaagaaaacatgtgttgtgtcacttcaggcactttttcgaagtcttttccctgaagatatcatttctgtgatgaaaagatgttgtactaaaatatctgcaatatacagtatagttagaacaagaaaatgaaagtacatctagactgcagttaatgaacactacctatgttttctcaaggtaacaacagagaaaaataaataaaataagataaattatttgtattaaatgaatattttcattttcaaaatttcggtctcattttatagaactggcacatttaaaattacctgatttagcaaaataagatctaaatacaattttccagaaatgtatgtattgtgtaaagtgagatatactggtttcatgtataaaacagtcagagaatgtcaatttatggaaataaataatttttaaatatctgttacccttactgggcatggtggctcatgcctataatcccagcactttgggaggctgaggcgggcagatcatgaggtcaagagatcgagaccaacctgcccaacatggtgaaaacccatctctactaaaaaatgcaaaaattagctgggtgtggtggcgtgcgcctgtagtcccagctacttgggaggctgaggcaggagtattgcttcaacccaggaggcagaggttgcagtgagctgagatcacactactgcactccaccctggtgacagagcgagactcgtctcaaaaaaaaaaaaaaaatctgttacccatgaaagataatcaatacctatcaaatattggattaaccatgctaagagcaattaatgtaacaatagctccaataagacctcattaaataatcaagtacttcaaataaacaatagatttagcaaaaagcacctagccgacagcattagtttcatttttaaaagactattctttagctagtgctgaaagcataaggcattgatcctttaaaataagaataaaggatacacagtttctagtacttttgactgggtggttacttgaaacattattctccaggaaattctaattttccttcagagatgttaaatttgctgcgagacttcacagaaaaatattttatgatatccgagttcttaattttttcccatgggcctgcttctcccctcaataattgtcagccagaaaaaagataattatttgtttaactcttaaacttttaggtatatacttattttatggattgttatatgacactgggcaagctaacttctctgcgtcccaatactatcacctgtaaaaaagctggtctgtaggtgatctgtaatagtgatctccatcctcttccccatccttacatagatgatggttaggataaactaccatcagcaacactggctcctccagctacccagttgagctgcctgttgcctgctcttccttcctttggagaaatcgttgatctaagataacttcagcattaaaaaattacgagtctagagtgatcatgagattgaaaacaactatctgaaatcatgcaaccttgagatgcattttctttttgagacagggtctcactctgttgcccaggctggagtgcagtggtacgatcctagctcactgcagcctcaaactcatgggcacaagggatcctcctgcctcagcctcccaagtagctgatactataggtacacaccactgcacccggctaattttttaattttttgcagagacaggatctctctgctacttaagctgttctcacgttcctgttctcaagtgatcctcctaccttggccacccagagtctggggttacaggtgagccacaaggccggcctttttttttttttttaaataaaaacatcttttttgtaaggttcttagtaaaaataattataataataatatatataaagggtgaaggctgtgccaccacaactttcaatacattcccttcctgccactcacttccatttgatgaaatcaataggaaaattgctgtacaacaaagagtagcatctgacaggcactgtgccaacctttacctcacactttcaaagaccggaagagttcaaggctttagtttacacatggtttggctactctcagacgctaggcaattgttgggtttcctgattacctgcaaaaacatttttggataacagctcattgagaaaaagggatatctacaaagacagaatatgtcatttttatggatctagctattatgttatttgtataggttgaataatttatatgtactatatcaactattaaattttggacaaatttttaggctttgccagcaaaattagaccaaaatttcaattttgaacagagtataaatctctcttctctaaattaaaaaccctttcccctgcttttagaaaacataattgcataattcaaactccttcaaaactgtgacctagttccccctcttgatgttataaagggctcatgtaactatggtaactaaccagggaaaattgaatgtttttctggtcagcaatatgcaaagtataccatatgtgctattttttctctttgggatagctaaggggatattacgtttgccttttttcttgtttatgaaaatatgagatcttattataccgaatttcctcttcactacaatcccagtcattcacacggtcccttcgttaaaacgttttaggatcatattttgcttttagtagtcatcctaaatgctgaatagtactataatctaaagcagtaggattgactgtatacaccagttaaatctgtgcagtctaacacataaactccaagtacagggtgatattgctcagatttctaatattccttctacagaatctgatattttcttaactttgtccttttttttttttttttttttttttaaatgagacagagttttgctcttgctgcccaggctggagagtgcaatggcaccatcttggctcactgcaatctctgccttccgggttcaagcgattctcctgtctcagcctctgagtatctgggattacaggcacatgccaccacgcccggctaatttttgtatttttagtagagatggggtttcatcatattggtcaggctggtctcgaactcctggcctcaggtgatctgcccacctcgtggcaaagtgctgggattacaggcatgagccaccacacctggcctaactttgtacttcaatcctagccaaagtgttttcttaaagcaaaagaactgctaaaatggaattacatcttggagtatatttagatattgagaagagttatctccagtttgtagtgacttttatatatctttttatttctatttaaattttttctacaataatgtgtattacttatgtaataaagtaataaaaaatgctttaatgctttaaaactgagttcagtggagacgcacaccattaggttttgttttttttttttctttgagacggagtctcgctttgtcgcccaggctggagtgcagtggcatgatctccgctcactgcaacctccgcctcccgggttcatgccattctcctgcctcagcctccccagtagctgggactacaggtgcccgccactacgcccagctgattttttgcatttttagtagagacggggtttcaccgtgttagccaggatggtcttgatctcctgacctcgtgatccgcccgcctcggcctcccaaagtgctgggattacaggactattaggtttttctttagttgctttttgtactaatgaattgatttaaagttttagggtttttcactataatttaagatgcttcactggaccttctagaacaaattacactctaacacagcctcctagattactaaggatttatttatttgcatcaggtacaattacatttcttacaacacgctatcaattggtgacttttcatatgaggatttcttcttgaatttctccatatttaaagcagtgattttaaactacttaaatatcttcctcagaaaaacattgctctctgcttcactgaattaaacagggaattaactgcctcttactggtttggaaaagacctcagtaaccaaataaaatgcatgggatttgctggatcctgttaaaccaaatgtgaaagatttactgagacaataggaaaatttgaattgtgtagttattaaatgatagtaagaaaatttggggaggcagaatacatggtattacggatatgcttaaaaaactgttatcttggccaggcatggtggctcacgtctgtaatcccagcactttggcaggccaaggcgggcggatctctggaggtcaggagttccacaccagctttaaccaacatggtgaaaccccctctctactaaaaatacaaaaattagctgggcatggtgacacatacctgtaatctcagctacttgggaggctgaagcaggagaatcgcttgaacctgggaggcggaggttgcaaagagccaagatcgccccattgcactccagcctgggcgacaaaagcaagtctcagtctcaaaaacaaacaaacaaaaaacaactattatattttacctattcatattattcatatttaaagtatttacagataaaatgataaaaatccagcaagagtgagggaatgtgaagggctatagattaaataatcttagccatatgttgctaaatgttgaagctgggtagacggtatataaggatttattgtagtattacttttgcctttgaaaatttccataaaagtttaaaaatattaaaaagtagaaaaaagaaaaggatttcatttatttgatctgactcaaacagaagctgaattttctcagcaggcatctttaggaatctttcaccattacttgccagtttgttttcaaccagtttgaagttgttgctctccccaagagacaggtacggaggcgtacacatttcctgccagggacctcttaaagtcagacttagaaattcaaggtaatcccagactaatttggggagatcagttacttatcttttttttagggttgctttatggtagataatacactgtagagcaaataaaatgcctttttgctttattcacaggattaaataccataaattaatttctagttgctgagaacgggagattttaaattttgcatttagaagacaagaaattcaatctgaagaggccccatatttccagttaagtgaccactcagaagggaaggacagcgctcaataaccaaggtcaagagttgggtttagggtttgtggcgattttttttgggggtggcaagaataagccgtagattaatctcttaaaataaatatagcaagaaaagcatgcctaaaataattcatacatatacatatattatcatattacagtgttttacagttttagatcagtaccagctaaaatattctttggattgtttttgcttttttaccagcctgttcaacagaattataaaaggtgacaataatgctataaatgtctcctatcccatgctcatccctcctctcatcttgctctgtttctggagtactctaggtattctgcatctttgcctttttccccttctagtttctaaacacatttcttatctacttgcagatcacttatcagactgaataaaatccataggtacattcggtgtctgacctgtaacaaggcaccccacattattttgcgcctttgataaagaccagcttattcaaacttgtgagaaaacaaaaatagcagggttcaagtaaaaaccagtaaaattcagttcttcacagtggcggttttttgacaagacccggccgaaagatttcacgaacagtaaaatcccagaatgttctcagaaatactatccactgtactgtctgggttgcttaatactggcccaaacctcagtgtcctaggataataacccaagacaatttcccagtcctttgaaatagttgacgtcccaagatgtcaaattgcctggagtgctttattttggtttgaaatttaaaatttcctctagataaagatctagatttctctttgcaagtcaaaggctagttactattaacagctgtttcaaaagtgctctaaataggtcaccattcaggtgtaccaacgctgcaaactggatctaagaagatccaaatttgtcaccactcactcacattttaactcaaaggtagtactcacaattggccttgtttacataggcattccattaaaattatccatgcattcattctatttgcacccatttctttcaaaaatgtccatctgtaattaaaatcagctcctctgcctgacatctcatttacactacaccgaaattaaaccccactaggagatcacgtagattatggggccgagggcccgcccgctgactaggttttcactcgcgtctcctccatgccccaggtcccctccgattgcagtcctggggcaggactgagcaaaaagtcccgtaaagctggcgtgtgccccactccgccaggaagcctcaccgacgtcctgtgcttaaatgttctgacaccccccaaaagcagttgtttttaaaggctgtctgtgggaccaatgcgttgtcaaacagatgccgtcccgcatcccctccccctaaatgacacagaagattccagcgtaggggaagggccacgaaacccgcagggcacacgacgccgggggccggagggagcaccgcctacctccctgatcaagccccgcggtgccgggcgagcccgagggcccggcaggaggcgggcggcagccccaggcgagctcggaggcggcgggaacgcagccgccgcgcatgccgggagccgcacgccgcccgccggggcgcgcagtcccgcaggcctcgctccaggtcgtccgaaaaggaaccgcctgctgctcctttgcaggctcgcgaggagccgcactcggaccgcctgatggggaaaaagccggtgtggccgggcggagcgagccgagcggagctggagctgcccctcccagcggggaggacggcacgaaggaccgagccgcctcccctcccgggtcccattcagacgcgaggcgcagagactggctccccgggcttcccctttaaggggggcggggcgcggcctgccgtttggccgccccccacaccctcccccgctagcccagagccggcagaccaatcgcccgggcggcggagcgaaggcgggagaatgcgaaccctccggtaggcggtaggggcgggccccggccttattcgcagggagcgctgcgcaggcgcagaggcggccgcgggcggaggggcgggggcaggctagcgggaggctctccgtgaggcacggagggtgactggggacaggcgggcggcgacgggcttgtcatggggatccgggctgcgagacggcactcgtagcatctggggactccgagggggacaggaagtgtcagcgcccgggaccccggcgccggccccgccgaggggatccccactgctccggtcctggagcgggaggggagaaaggagggagccccggtttcgccccgcccctgggctggtgctgcgggggcggggagtgagggctgctctggggggagtggagatcggggagcgcggccgtgccctctcgagcggctgcggggtccccgcggcgccgggctgctgagctgagggcccgcggcggccgcggccggtgcatgtgcggctgctggatgcggaggcggcggcgacggcgcggatcggcaggatgttagggcagcagcagcagcaactgtactcgtcggccgcgctcctgaccggggagcggagccggctgctcacctgctacgtgcaggactaccttgagtgcgtggagtcgctgccccacgacatgcagaggaacgtgtctgtgctgcgagagctggacaacaaatatcaaggtaggagccgcggggctgccggcctcgggagccggtggcggggagcctgtccgggggagtgccaccttccctttctcccgtgacagtctccccgagcgcaccgagggtctgccgagcgggactgggaggactggagaccgggttggcggccctccgtggccccgcggtgggcgagtacttctctggggtccccagagtgggggtgggggccgcttgtcagcccccgctgcagacccagcggctgcagctgccgctgaggggaatcagccattttaagcagcaagcatttgttcaggcgctggcccgccccgtgccgcagaccctgcggccccggcccgggactgcagccgggcaagggtcggagggagtgagcggccgggctcccgctggtctgcggggcgcgcttccccacctcactcgcccccaccccggagtgcgggtgctttggaacgtgcggggggagggggcgagaggccgcggaggcggactgagggggccttcctccgcgctcctgccccggcccggaggagagcagtccgttccgctctctcgccccgggaaagttcgcgggcgccccgcgttgtagccctagcccagttctttcggcaaaatggttaagaggggaggggtcccccgcgggagaggaagagaggggcgtgtgtggcggggagggcccccgcgccgggggcggggcctgcgggcttgacgaggggcgtgggaggggcgcggcgcgcgttcccgcgggcctggaaaatggctggtcgcgagaggggcggtggcgagctggctgctggggagggagtcggggctgtgcgggggcgttggttcggccccagcggagtccgaatcggggtttgcagcatgttttgcggtgatgtttccaacctctttcccagtcaatggatcaggacggcgatcagcagctcggaccgtcgcggatcctggctccgcgtaggttccgggacatgtgtcacttccgggcttcaggaggaagtgggttggttgactgggcaaccgcctggcgtccccgagcccctccttctccgactttaagtgtggaggcgaaaccaccctttgccggccgacccgggaacccgggacagaatcgaccttccttacagtgttaccacctactatcggtggtgctactaggagggcagtttaaaaggggaaatgtgttgcgcttaataaccttgaatcgaggaacagaccttgaacatagtatggaaacagccatacgaactttaaagataatttcctggacccattctctgtttttgtagacacgccagtaatcctatactttaaaagtctctaaggaatccacttcttgggtgacataagtgtctgatgttttttagtttataaatttgtttctgttttctgaatccataggattcataggactgatccgtgtttggggagggggtggggagggaattaaaactgatgcgctgggtccagaccattatataaatatttcttttacagattacaaagagttcaagtaactcgtccagttaattcgatgtagaatatttggctccagagcctgctactgtagatgcatatctttgttttcaaacaatttaagttttaataaaaactgtccaaggggatttctacagatatggagcacaaacatgaatggtaacctaaaaatgatacgtgcttaataattgtatatggaacctttctagtttttcagataacaccaaagtttgtaaagcttgtagtttgtgttgttgttttagacagagccttgctctgtcccctaggctggagtgcagtggctcgatcttagctccctgcaacctctgcctcccgggttcaagcgattctcctgcctcagcctcccgagtagctgggattacaggcaactgccatcacgccgggctaagttttgtatttttagtagagacggagtttcaccatgttggccaggatggtcttgaactcctgacctcaggggacccgcccgcctcggcctccgaaagtgctgggattacaggcgtgagccaccgcgcccagcaagcttgcaggtttttacatttctttgaaggcacatgtttcctttcacaagagttaagctatttgaagttggtgagggatactataatttgttgacagggaaatctttcggatcatctataattgtcaggtattaatagctctggtaacattagtaatatagtaggccttacaagattgagagattatacaaattcttagctctatgaagtttgtgattagtgattaaaaactcatctagttttcactctgcacgtggttactgagctcaactttcacagttttatgtttatgtatattttgggttcagatttcatgttttttatatcttcactagtgcttaagtattttctggttttggatctaatatttctagcaatatttagtgatataaattatataggcagtcaaatttctttctaacctacttgagacactttcagaactgctgaaaaacttataaaatgagaaataaagaagaaaacaatttcacaattgaagtacttattatgggatagggttattagagaacctttatttttattctagtgttcccactcataatttcttagataaataacaaccttcaaactaaactttgatacttaatttcaagtgcctttcatatagtttatagaaagtgcttacactgcgaggtcagacatacagatctggcacagttcaaagtctggggttcttatctcttgagttgcagtttttttcacaagcagaagtgatggcttcctcatggggttgctgtggagattaactgagaaaatctttaccacatagaaggggctgagtaaatgttaatttcttgtcttctttcactatataatacggtatcttacaaattttttatctcatctatcaatgtgctggtatgatatatactgtacttagcctctaacacctgattattaggtacaaaatatttgaaaagaggtttgcctcttttttttttaatcctcaattttttatgtgtctgagggaaccagtttccttatttttcctgtagggaaatgaggttcttaagaaatctgcttagatgccgagctaagcaaatggaatagacatgaactttgttcgaaaatatgctatgcaggtgtaagtactctgaactgtgtggtggcactttgttatatattccaagttagacagttgtacatcaagtacgagtacctgcgatttccagggagaagctgattaatgagttctgttgaatatttgcttttgtgtgccttacttgcagacagccccaatgtatatatctacttgcctaacatttctgtttttaataattataatattggaatataaaactagtatgccatgtggtatgaaaaataccatgcggacagaactctttgagatagcattacatcttgtaagaataagaaataaaacggattcgagcaaaactaatcttaagtaaatttttggtgacatctgaaattatattttcagatttttggataccttctagtgactcagctatttttacttgatttaagtaagtgtattccacgtgccatacaactaaatcagcagttcagaaagctcagaaccaactactgatttatctacaaaggcagaatgatcgagtgctgactttattgtaattttgttagtggtttggtcagttgatgccagaaccagaacctactctggaaatagtttcattttcagaatttcccatgtgaggctaaagtagagccattaaaagtaagatgatgggaagctaagagttgcttatgccttctttgttaagaatgtatgatgtgaaagtgaagctatatctccggagtcatgtcacaagtcattgtcacaagtcattgattggactgtaaatcctgtaaacacagttgggcagtaatctgtagcctagtcctgtaaccttttcaagttttagagctggaccccagcctgcacattttatatatagggttgttttgaaggtgttacagtacttagtagactaaagtggcattcagtgttcctgcccatgagaaatacttttgatcattaattagccaaacatctcttatcctttttttttttttttgagacggagtcttgctctgtctcccaggctggagtgcagtggcgcgatctcggctcactgcaagctccgcctccagggttctcgccattctcctgcctcagcctcctgagtagctgggactacaggcgcccgccactgcgcccggctaattttttttgtatttttagtagagacggggtttcaccgtggtctcgatctcctgacctcgtgatccacccgcctcggcctcccaaagtgctgggattacaagcgtgagccaccgcgcctggcctttttttttttttttttgagatggagttttgctctgtcgcccagaccggagtgcagcggtgcgatctcggctcacggcaacctccgccttccgggttcaagcagttctctgcctcagcctcccaagtagctgaaatgatgaggggcgcctgccaccatgcccggctaatttttgcatttttagtagagacagggtttcactatcttggccaggttggtcttgaactcctgacctcaggtgatccacctgcctcggcttcccaaagtgctgggattacaggcgtgagccaccgcgcccagcctctttttaatatagattaatgagtattagttttgtgttctttcttttcattactttatttctaactatactttcatattagataatgtggtctttgtatgaaatagtttttaatgtatatgtaccaaagaggagtatggtttcatggtttgagttctaatttcaattctgtaaaaaataactaccttggaaatgttgtgtctgctaacacatgataacgttctcatttttcttttcctttttttagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttgtctgtgaccttaattttctgcactgagttaccaaatatttccaaccaggtagtcttcagatcacctgatgaaaggagcagggaacaggaagagggtggtgtaaacattataaaaatttcacaaaccatgcctatttcattttcacttaaaactgcaatgttattttttgggtaaacacaaaagtttcactagcattttagttatacatgcttaaaaaaatgttagatgtagtgggatttctcttaagcatcaaatgatcttgggtactttaaaatacagacactatgccatttgagctgctttttccctagtcctatttatacgttggcttgttcatctctagtcttctaggagtttaaggaactggagataagagtaatttgggattccatgtggaataatgtgctcttatgagagtacgtgctgctgtcttttgcttagtagcattttgatccactgtcagtagcccatttgtcaatgccttgctgctgctttgtagatatacttagtctagtgcttaataagggagttgttttgtgttttcttttaattgggacaggtaagagtagttagcataccaaaaatatacattggcttacattggcaaactttgggttatatagtatcacggctcaaggttgaacaatttaaaaatacatcttaattaatagtattttccatgtgacctgctgccaggatgcgtagccacaggcctatcagtggaaaggggcatatagtagtctttaaatattgcctttatgtcagagagttgttttaaatggttttgctagtggttattgttcatttctgtcccaatcagtgactattttaaataatagtgtatttactgtcttaacttctagtattggtgctgtttgatgttttcacatttaattaacttatttcatcatcataatgcaattaatgtatttgtaaattgaattttccaagattctgatatttgaagggtaagcatcttgatggatatatgtccatatgtttagagaaggttttggttttgggggcagcagattgactagttctttaaatctgtgtgtaacgtatgttttattcctcatttcttcctaatctgatgatcttgattctttttgattaacatgaaaaatcctgtctgcttgttttgggaaaaaaaaatgctttttttctcttctagctctcctgtgtgacttttaggcatgtcatttcaccttgtctgggtgtcaggtcattcacctgtaaaatgagttggcttaaatatctccgagattccttggaaatttctactatttgcactatagtgaggattttaataatgacatgacttctcttttcattaattttgtccttcattctgaggtataaagatagtttaaaggtgagtttggagatgggtaaatgtgcaatatttgttagcttctgtcctaagaatatttggattcatgactagagctagttgattctattaccttttgagtgagaaatgttagacagcatgattaagaatttagcaaatcctttctcatcaccataacttagctgagttgtaaggaaatccttttgagaatatggcattttgttttagtgattacaaccttgttaccagaatggagctttttacttgacaccattaaaaatatcagtatggacaaaacccccaaagccttcagatgcgacttacatagaagtcaccactttttcatacgtaaatctgccttggcagatgggagaaaagaaacgacttcctaatagaaatgccaaagtttggattagacttgacgggaaaacgaacctggaaaatcctggaaggtgtgctctctttaagacctaatatctgaaacagttttatgacttttttgttttgttttctacacatcttggaaatagaagtcttaagcatgcgtagcattaggactggaatttcttttgttgagtattctggatctcatatcatggttaccaactcatactgtatacaccagtggttcccaaacttaacgttggaattacctgggagtttcaacaaatactgatatctgtgccccaccctcagcaattgtgatctaaattcatttggaatgtggcttaagcattagaatttttaaaagatccccattataatatatggaaatgttttggaaccactgccacatttcacagttttcaacttattgaaagctgctgtggattatctacatccagatttatgcaaatctgaagcagatacagatgcttatacacacatgagagtatctcctgcccccagtggctccaccaccagtgcctgaatactcaacatctgagtgctaattaatgtgccaggcaccgttttaagcagttgtggtgtaaaaaggaaatatccctgcttgtggacgatacattctagtggaggagtcagatacataaaatgtcaggtaaattgctaaagtgaaaggaaaactgagtaaagggctggaaatgaatggaagggggggtggcaagtcttttatttatggtaatttaaaaaggtgtccctaaggaagtaatccttagagctaagagcagaaataaggcaggcaaagatttgagggagggaggagggaacaagcttggcaggttgactaaagcagggcattagagcacagtgtacaaggggctgggaactggggactcttggaagccatggtaggaaacttgggaagccattgaggggtttgagccatggtctgacataaaggtcactctggatactgtgtatacaatattatagggaacctgggtgaaaatagatttaggagaagcaactcagaagatttaatagcaactcagaagtcttcacatcgagtgttggtggcttagcctagggtggtagcagcagcagtagtggctagtggtaggactctgtgtactaaaggtacagccaacataactttggcccagggattggaaggcaaagagatgacaagggtgactcgggtttttggcctgaagggggaaaaagaataaaaatttatggtttgcacttaggtttgagatgcctaatagatttccagtagaatccagcatggaacccggcatatgaccgttagggtaataggaggtgaacattttggagagtcatctctatggcatttgaagccatgtgactgaaattactcaggaaattagagcttctcaaatgttaataagcatgtttggttaagatccagattctgcttcaggagatctgacgtggggcccgagggtctgcatttctagcaagcttctcagtgatgctgatgccgctgggccggggcccgcattttgagtagcaaccaagtagatggggaggagagagggtcagccctgtgtcactccaacatctaaaatggggaggagccagcaaaggaacctgaggagagctctccgtgatgtgaaataaagtgtttcaagaagggagtcgtcggctcattcaggtgctgttgaaggaagatgaacacaactaactgttagattggggggattgtcgttaacaagctgcacgtttggagtctggattgtgagcagaaggggactgaaatagagatggcaactgcagacaagccttgcaaaggggaacagagatgggttataactgaggcggaggtgagctaagggaggacttaagctattcgggaaatagtatggcatgattgactatatgctggaggaatcccgttaggaggggcaagtgaatgctgttgatggggaaactgaataggcaagacggagtgggatgcaggactcaggagaggctggtctcagtaggcagaagaggcagtgccttgtccatgtccacagggagggcagcacttttattcacttactcaaatatttattgtgcacctatttgcaaggcatcgtttgtactggggataaagcagtgaccaaaatgagacaatctgtaaccttgtggagcttagattctggagtgaatggggcgtatatgcaggtaggttgctaactttgttattgggaaaatgatagcttccactttcccagctgaggaagtgatggggaagggagttgcaagtctgtaggaatgagaggtgtggagcatcacctgggagagtaggagagtgaatggccccggaatgccaggactgtggccaagctgcaggtttgggtcaaaacttcacatgagctgactactcattttgttgcctggatgcagacatgaaaaaataaacaaaaaataacaaattttcgaaatctctacagtacaccagaaaaattgcatctccccagtccttttcatatacctattaggtggcttcctctggggttctgtcctcattccccctcctgaaatggaaggagcaaattttcaaggagcagttaatgtaagtaagctagacggctagacggctcttcagcgctgtctgaatcaagtacttagtagttttatgttgttcaaaatacattttaagtgaagttagttattttgggacttcctttactatattgcctaaactacatcaatcagagaaaccacagctccttcatcgtctcctatttcaatgcgagggaagtggtctggaccaagattccagagatgtggactcaacctgtgatcttggacaggtcacttgtcctctttggcctgcagtttgttcagctggaaaatggctgatttaatatatggttacctaaaagtgtggctgttattcatgtcttaacattagtccgaggaaagaggtctcctggtcacaaacttactaattgggtagtttataaaataacagctttaattcacgtgcgttgtaagtacactttaaagcagggctttctaaacttcagacaccacagacagatcttgatggattttgccatttctgcacaccattctaattttatatttaaaactactatgtgcttagtacttttaaagtcaactcactgtttgatgtaaatttattttaaaaaggaagcatatcactttggcaaatggaaaattagtatcactttctgcaactagaagactaccttaaaatgtaataaaaacagtgttattaaacactagctatgcagtatggccagtgaagagagcccaaagtctatcctttttttaattaaaaggtgtgataagtaagtaacgttaggtaagggtaaaagacacgtaaacaccaaattgagtctttctgcatgatgtgatcaaatggattttgagacttttcttgagtacttaccttaccatcctactctggaaaacacttttaacaaaaggttaaccagtgcagttccttgactatcagtataaaacaatattaacatttcttagtttaacagcacttgtctagctgcatgcagatggatgttgcctcttaattaaggtttctgtaaacctcataaggtatttgccaacattgtctatatcggtactagagtgacattatcctgaccccaaaggagtttctagtcttacctcttttttcatctgaggattaaaaatggcacctcctcagtgcatctctctttttttttttttttacacggagtcttgctttgtcacccaggctggagtgcagttgtgcgatcttggctcatggcaacctccgcctcccaggttcaagcaattctcctgcctcagcctcacaagtagctgggatcacaggcgtgtaccaccatgcctggctaatttttatattttttgtacagacagaatttcaccatgttgaccaggctggtcttgaactcctggcctcaagcgatccgccccgcccccctgccccccacttggcctcccaaagtgctgggattacaggcctgagccgggcggtagtgcatctctttgggagctgagagaggtttcctgggccagccttgcaataccatcactcttgggcccagcattccagacctgaaaaatccttagaattacccagctaatttcctcagttatccactagctagtgggttcttgatttagcagtctctattatcaaaacaaaaattccaatttccttacaaattggataaaagcaacatgtccatgtcataaacacaggaggaatgagatttttactgcagcagcatattttggtattttggatagctgtgtacctataagagctaaaagtagtctttcagattttaattgtattggataaaaattttcctgccttcttaaatatgtccttaaattcttcttggcgtatagtaggacaaacaaacatttaatgtattcatcctttgactcaacaccatgtgattatacagtgatattcttaaatcttgctccagtatggaggaccatttgcctctgtacttgcttccgagtgttttttaaaataaatttggctgcttttgatgtttttcatgcttccttgcttctaaaactgtctgccttgtagtttgtatccctcttagtttgttgtgtgttggaaaagcatttggttgaatctgtgtctagcttcagaataaatagattctaagagagtatctagtgcttgacttcaatgtatggttttttttgtttggttttttttgggtttttttgagacagagtttcgctcttgttgcccaggctggagtgcaatggtgtgatctcggctcaccgcaacctccgcctcctgggttcaagtgattctcctgcctcagcctcccgagtagctgggattacaggcatgcaccaccacacccggctaattttgtatttttattagagatggagtttctccatgttaggctggtctcgaactcctgacctcaagtgatccatctgcctcagcctcccgaagtgctgggattacaggtgtgagccaccgtgcccaaccagttttggtttttttaatatgtggattgttttttctcccctgttcttgtggtcagatagcagtgtttcaccatctactagctttgaacagcaagatctaattgctttgtttgacaagaggacttaacttatttatacagtattctaatcttagaaacttcccacacagaaacagatgttaggccagctggctagttttctctccaggtgttcaggttttagattagtaatatggaatcatatacccttggtgggaagtaatctttttgattctaatagaagaatgtggtttaccaactatatgaaatggtagaacatagcaatttcaagcctttttgacagacttccattgcttttctgtgccttcctgagatgtgataacatcttccaaatttcagaaattttcttctgtaatcttagaacacattttcctttttggttacattcatttcccatcaacttgaaaaaagtaaattctcatagattaagcaattataaagcaccgtagcaaaatcatgactgggaaattcaattttcacagcaaaaactttgcagtagctttggctttgagtttatagtgtttgagtattgcgtagactattttcttcatcaatgtcattgttacttcaggataattctgactaaggtgcaacttggtggaattgacaacccagcacttttctaattacccagtgagaaataaggacattttcctgtgcccagttaagagagggagaaaagctagagttacctaaagtattctctctctctttttttttttttttttttttgagacagcctcactctttcccaggcaggctggagtgcagtggcgcaatcttggctgattgcaacctctgcctcccaggttcaagcaattctcctgcctcagcctcccaagtagctgcaattacaggtgtgtgccaccacgcctggctaatttttttattttttcttttgagatagaatttcactgttgttgcctaggctggagtgcaatggcgcaatggcacgatcttggctcactgcaaactctgcctcccaggttcaagtgattctcctgcttcagcctcccgaatagctgggattacaggcatgcaccaccaggcccggctaattttgtatttttagtagagacggggtttctccatgttggtcaggctggtcttgaactcccgacctcagatgatccacccgcctcgggctcccaaagtgcagggattacaggcatgagccactgtgcctggccttgtattttttttttttttttttttttttttttagagaaagtcttgctctgtcacccaggctggagtgcagtggcacaatctcagctcactgcaacctccacctccgggttccagcaattctcctgcctcagcctcccaggtagctgggattacaggcatgcaccaccacactggctaatttttgtgtttttagtagagatggggtttcaccatgttggccaggctggtctccaactcctgatgtcaggtgatccgcccccttcggcctcccaaagtgctgggattataggcgtgagccacctcacccggcctaaagtattctctttctattttagtcttcactgtattaaatttattttaaattagatttcccctcctaatagtagactaaatgcctaattatctggaattgattttaaaaatttatattattttcatgtcacttgaagatctcaaaacaagacttttatccatttaagctaacaagagtgagtctgggttctttgtaaagcacttttgtaaaaaagtaccttatgtgtgagagtttgcagtacctccctaagtatttcaacaagtggctagtccagtgagttgcaaatagtagctaaaagtagatttttatactactttacatccaggattaaggtagagggtttactattttgttttgttttgtttttactagatacttacatctttgttttatttgttatgctccactgaggtctgtcctaccaaagggacaagagaagcaactgttatgccatgaaaggaattttcccatacataagcattcgtaaataatccccaagtgtaaacacagtgccacttgtttccttaacattttctcagacctgccacatcctgactttcgacattgatatgacaattcaaagataacttaagcagaatgtgaaagataatttgcaaaagcatgtcatgtagaacgtggagaggaatcctgtagtaactaggcgacgtccctcggcttggggtgagactgtgttccaaactacggtttcccaaagcgttccgtggatcctagaatgctaactggcccaagaaagctgggatactttgcatataaaattcttcctcttggagattcagaaggcacatacatattagaggttctgagaaatactgccacttttcccccataataccttactattctgaggaagtagggtcctttcaaatggtttgaaaatgttgccctacactacaccatgaaaggatggatcatattcaaatctactgagtaatcctactgtagggggacttataccccagctccctactttcccatatccagcactatggtcttggtgccatttgtaccattgtttaaagacagcagtcaggcataaggactggtatcttctttctactagacagtactactcaattgggtggaggagaagtataagtgtttaaagcctccctaaccaaatctggtgcaacaagtaacaatactgttcaagaattgtgtgtcaaatacaattgggttatataacccactagctcaaccttgaaaataaattaacttgtttggcttcttaattggtagaattcgtatacgttcatagtcacacatggatagtaaccttcatatttgatcagaggaactcccagaaaggaccactgttcgtcttatgtccctttctgagaaagaaaggactataaaaggcaagtgataaagaggatctgaattcaagccacattctattgttaccatgagggtcaagtagatgtgagaagtggccctaggcaacgatctcgtgctcccagcaggctctgaagtttattcgaatttaacgtcatgatgcgcctttggctttataacctgtaaagatcaactaaactgttttcctaggagagtcccattgtcattttaaagtaattgtttctgtaaaatgcatttacagaaagtcagatttgcttaaccagtgccaccatcaaaactttctattaagggtggacaaataccatctgtagatagaattaaaacctgaattgtgcatgaggcacaagatctctagagaaaaggggtagttaattgcccaagagtaataattccagcagagtcattgacggggctccaaatttgccatttctagcatgttttagtgagagagtaggaaatctgtctttctgtttgtttcatctcttaattagttgaagtcttcaggaaaatcagtagctatgaaggattaaatgatgaatttattcctggagccagaaaattgagttacagcagtgttcgatgctctatatactgagaggtaacaggctctctgtcactctgtgtaaatttttgtggtaaagctattttgagactagtttactgtttattctgaagagaataaaatatgaagtccaagggaggaggatgtgcaaagggagaatttcccttctcccttttcataaccatcctctcatcttactataaaaatgggggccggaagctctgaccctgccaccatattgctgtgatgcgttacctgagttccacaaactgctggagccatacattctaaaacaatgaacaccaaccagcttttcactttcgtggtttcgtcacggttctgaacaccacactatgctggagagcataccctttagtggcttcagattttaaaagcttatgggccaccatagggaacatttgaaatactgacactgggaaaccttttctcaaagcaccataaagaagtttccccccaaatccttgtcatgtttaatacaagtttatgaattttaacaattcccaatgttcatgtttcaatcaattgggaactaataattgcaatactaaattcagaaaaagtttttaactttgagaattatatatgcttttgtttgttgcaagaagtataatagggtaatcaaatgactcgagaataagaatacatcattaggatactattttgtgggggaagtggaatggaaatacaattttaggggaaaagcaatgttaaaactcttattgtaggtatttaaaaaaatatgtggtatagcacttagattccattgaacttatttgagccatgtaatatttaaattttttatttaaaaatgacagtataggccaggtgcagtggctcacagctctaatcccagcactttgggaggccgaggcaggtggatcacttgaggtcaggagtttgagaccagcctggccaacatgacaaaactccatttctactaaaaatacaaaaattagccaggtctcatgatgcatgcctgtagtcccagctactcgggaggttgaggcaggagaatcgcttgaacctgggaggtggaggttgcagtgagccgagatcacgccactgttctccagcctgggtgacaaagcaagactctgtctgaaaagaaaaacaaaaaagacagtatagacaatataccggaaattacatttgttgtaatcatggaagtttatagcaaaacattttagaggtcaacttatatatgtgagagggtgcgtagtatttcaaaaaaattttaagatatgtgaaagcaaaaacattagaaatggacagaaacaatctgttcaatattctggccttgactcacaccttaaatcctgcctcagccatctacctccttggagttaccttagactttgcaagtaccaaactctacctaccaccaaaaaatacactctcaatttgaagcatcccaccctctggccaacattgttgttcactccctcctctactctcactgaacagttgttcagcaccaccatgacctccaaaatatttcctccaaaccctccttcctacccttccaccttcccaggttggccttggcctctgcctgactcagattgtgtggctgtcatgttaatcacccgctggtacacattttcaaccccctcccttgccttggccctgtctaaccctgtctaaacccagctgtcagcctcctcagccgctgcagtcaggcagctagtaagtggccagagtaacacacgactatgctgatggctcatttgttcaattagcgacagagttcaagcaggcccttcaagctgcctgacaatcctcctacattttcttttttccttttcttttttttgacatggagtcttgctctgtcacccaggctggagtgctgtggcgcaatctcagctcactgcaacctctgcctcccaggttcaagcgattctcctgccttagcctcccaagtagctgggattacaggcacacgctaccatacccagctgatttttgtatgtttagtagagacagggtttcaccatgttgaccaggctggtctcgaactcctgacctcaggtaatctacctgccttggcctcccaaagtgttgggattacagacatgagccaccatgcctggcccccctacattttcttagtcaagttactctttcacctccgagaccatgattctactttttcttctttcttcaaaccttcagtacccaatatccctctccctctgccttcacagggtgattaactcaattcttattttgttaaaaacaacaaaacaaaggtcatcggagccctccccctgtttctaccacaactgccagcccacctgccttccatctctttacagtggatgattgtctattcttagggccaacccttcaacctcttcctatgtgcaggaacttcactctcgcaattattccctctctcaatcatccatgtttccccttccagtggacctttctatcggtatgtaatgttgttacagtgccaatcttaaaaaacaacaatgaacagctaactaatgtcccattttttgtgtgttcccctttgtggagaaactcctcaagagttgtctattccattttgttgttgctgtttttcataccaacatttattaagacttatttttctatggtcctcaatcacagaacaattaagcaaccatataaaaatttaatgtacctgaatatgagatgttgctttttttttttaagacaggatctcgctctgttgcccaggccggagtgcagtggcacaatctcggctcactgcagcttcaacctcctgggctcaagtgatcctcccacttcagcctcctgagtagctaagacaacaggcatatgccaccatgcctcgctaatttttttattttgtagagatcgggctcttgccaatgttgcccagagtggtctcgaaatcctgggctcaagcagtcctcccacctcagcctcctaaagtgctgggattacaggcatgagccgccacgcagagcccaagagttgtctattcttgtctctgctttctttccttccattctttccagaatggcttcgtctcaaacactccaatacaactgccttaacattagtaaattcaattgtcaattctctgtcattatcttttcctgctctcatttgacacaaatgatcacttttaaaatgctttttctacttcgtctccagggtacaaagtacacctgctctagaatctcctccaacctcagggactgtttcttttctatctgctttgcggaatctgccccttcttgctgtcctccaaatactggagtgtcctaggtgaaggcttcagaagtcctcctcatataaccattccctaggggctgtcatcctgtgcactggctttaaacaccttttatactgtgatgactcccagtttctgtcaccaatccaggactccgatctagacggacatactcagttgcccccagcatttctgttggtatgtcaagtgaacatctcaaacttcacggggtagttcctagttttcaacctccctcccagcacgagccttctcttcttcctttcatggtaaatgaaaatgaaaattccatcttttacttgttcaggccaaaaatcttggaatcatcgttgactcctttctttctccccatccaccgcccccctcaccgtctctctctttttctttttctttctttctttctttttttttctttttttttttttgagacagggtctcactctgttgcccaggctggagtgcagtggcatgatcacaggtcaccgcagcctcaatttcctgggctcaagtgaacctcccacctcagcctccccagtagctgggaccacaggtgtgcaccactatgcccaattaatttttgtattttttgtagagatgagtttttgccgtgttggccaggctggtcttgaagtcctgggctcaagtgatctgcctgtttcagcctcccaaagtgcggggattacaggtgtgagccaccacacccgtctctttttttcccttatactccaaaaccaatttgtctgaaaattctgtcagtttggccttcgagatatactcaggagcctgctgctctgctgccccttgcctcccctagaccacggtcgcctctaccagggctgctggaacaacctcctcatcagtcttcctgcttccacctctgcctttatgtttattgtccgtaaagcagataaagagattcagccacatccatctctcctatgcctaaaatcctccaatggcttcccgtcttacagtaaaatccaaagtctttatgttggcctaaaaggccccgtgtaatctggctctgagctctgacttctcctagcactctctttttgcttactccattccagacacatgggccaccttgctcttccctggacacacccgacactgtctagccacgggcctttgcacttactcttccctctgcctaaatgcttgtcccttgtctcagatttccatttcagttgctccttttatcgtgtagctaatcctgcaatgcctgttttataatctagaatgctgtttgttcctctgacccatcaaaacccttctccaacatcatcgaagttaaaatgaagatcataacctaggaaactctaactaaaggaaggttttctgaacttaaccttttcagagaattttaatactgctagtccagctaaagtgatattaatccaaagaaatcttgactttgtgtaaatctcaggcagtatacaaagacaaaattcaaatagaaaagaaataacccctatgaaaagagaaagtgttctaataacatgttatcaatcccatcacttttttttttttttttgagacggagttttgctcttgttgcccaggctggagtgcaatggtgtgatctcggctcactgcaacctccacctcctgggttcaagcgattctcctgcctcagcctcccaagtagctgggattacaggcatgcgccaccacgcccggctaattttgtatttttagtagagacggggtttctccatgttggtcaggctcgtctcagactcccgagctcaggtgatccgcccagctaggcctcccaaagtgctgggattacaggcatcagccaccgtgcccatcaccttttctttttcttttctttttttttaatttttttttttttgagacagagtctcactcttgtcacccaggctgcagtgcagtggtgcgatcttggctcactgcaacttctgcctcccaggtttaagggattctccagcctcagcctcccgagtaggttacaggcacgcaccaccacgcccggctaattttgtatctttagtagagatggggtttcatcctgttggccaggctggtcttgaactcctgatctcaggtgatccacctgccttggcctcgcaaaatactgggattacaggcatgagccactgcttctggcccaccttttattttcttcgtagcatctggttattggactgtcttctttcactaaaatgtaagctccttgagagcaggaactgtgtgtgttttcttcacagctgtatttttagtgcctagaacagtgctgacacccaatatgttatgtccttaataaatacattttgaatggatgtcatgaaacttttgttgatccaatccagtgtctttggtttttaaacctatcatcccttctcactaggcctgttttctttctttctttctttctttttgagatggagtctgttgcctgttgcccaggctggagtgcagtggcaccatctcggctcacagcaagctccgcctccctggttgacgccattctcctgcctcagcctcccgagtagctgggactacaggcgcccgccaccatgcctggctaatttttttgtatttttttagtagagatggggtttcaccgtgttagccaggatggtctcgatctcctgacctcgtgatctgcctaccttggcctcccaattttttttttttaatagaggctgggtgtggtggctcatgcctgtaatgacagcactttgagaggccaaggcaggtgatcacttgagcccaggagtttggatagaaagaaagaagaagaaagagagagaggaaggaaggaaggaaggagaaagaaaaggaacaaggtaagaaagaacgagagaaggaaagaaagaaagaagaaagaaaaagagagagagagaaagagaaagagagagagagaaagagagagagaaagagagagagaaagagagagagaaagagagagagagaaggggaaaaaggaaaaaaaaaagaaaaaaaatagagatggggtctcgctctgttgcccagattggtctcaaactaccaggctcaagtgatcctcccattttggcctcccaaagtactaggattacagatgtgagccactgtgcttggcttcactaggcctgttttcttaggataaagatgtcgagtggattaagtgcttgtacctattactaagtaatattaaataattctggtaggaaatccacttctcagggcatcatgggagcacttagttattgtattttttcccctaaatttaaaagttgatgcattttgtccaagtggggaaaaacccaagaatgcttttggttccaaagcaagaagcaaaatttgatgttaagtaggggaaataagaaattaattttaataatgcttacttcgtcaagaaatagtgcacagcacaaacctgttatagaagcattacatgtacagtcaaccatcacaaaatactaatttcctattgagcagcttggtctgagtaaaggaagatggggctctctgaagttttacttgaactctgctctgatctcagaagcaaaatccatcagattctgtgatggtcaagtcacacacacagggcttgctgcttgtccattgggaaagatgaagagtcggcttgttacccttgctctcctatgtcaaattgtagacaaccatcttctgttatccagacaccaaaattaatcagggaggaccttttgcagggctgtctcggtcagtgtacaaaagcttccttttcagagtgttgttctgcacctcaagaagctgaagacaaacagtaaatgtgcaaggtcacaggtatattagaagaaacgttcaaaatgtgacatcccaagatgatacttgttggccacagttttgtatggttcaaggacagggaggtggagcaacagcaaatatttggcaagagtgctgtcagttagatacccatgctggacatagctcatatttttcacgatactctttacttgctgaacttcaaagacctccaaagttcttctcaatatagattttaggaagccaccatcaattgattggcattaacactgaagagcaaacccatttgttttttgcagttctgatggaactttcaacattcttcacaggcaggcactctgctttctgattgtcattctttgttgacaattttgcaaaagatgaaaatctgtcattgttagtcaactcatcactgactgggttaaacaggatccacagagaatttgccttttgcttgctggattccaaatgtgggtatttttccccttctaagtatgtagtgaagtaccttgagattttcaggctgcattgagctgagaaagcagagatcagcacttctggattagaccccatgttaagcatgtaacacaggctcaccaccaacagactgcaacgggaatggtatgcatggcttacctctagccattattttgcccttaagagttgggactcaaaaaaaaaaaaaaaaaaaaagagttgggactcatgcctgtaatcccaacactttaagaggctgaggtgggagggtgggaggattgcttgaggtcttgagttcaagaccagcctgggcaacagagtgagacccatctctacaaaaaaaaatttaaaaattagctgggtgtggttgtgcatgcctgtagtcccagctattcagaaggctgaggcaggagattcgcttacacccaggagttcgaggttgcaacaaaccatgattgtgtcatgcactccagcctgggtgacagagcaagaccctatctcaaaaagaaaaaaaaaaagttaggactcttaagacttagtggtagtgtagttgagacattcttagtaggctgatgtcttttctacttccttctaaaatgcctcccattctctttaacctttgttgtactcaacagttttgtcattttttaacactgtctgattgtgcctccattgaagccatactctctgcacttgctttttacatctctgacccctttgtgtatctgcattagtccctcttctttctctggctctttagctgggagtgtcttctgttgcccagccctggcctcctgttactttccacacactcttctgaaatctcaagcttgggtgggaaagcaaaggtgtcatttattcactccctaaaacttccacacttagtcaataattggtcctcaataaatagttgttgagtcattaaagaacttttccattgtacagattctccccatcccatgttatttggcttggtccaggagaggacccattggaattgcagactcaaaagccaagtggcaagtgataggctagtatggggtctctggtagagggaacaagtcagtcagcttgtgtgccagatttcttgcacagaaccttgtcccagaagtcagggtgtctagcacagcacaggtgaggtgaagttagggcagaactttccctacagactacaccacttttgagctaaaattgaaaatggaaaatttccggtaactgatcactaaaatctctcttggtgtttattagttgctccttggaagagaggagtggattagacatgttttatccataataaaacagagttctgaaaggtggcaattgaaagggtagaagtggtcacagaggtgttctctgctggtaaaatctgctggctggattaggacgggagtggtgtagtcttctttctagttgtcttttttcttccattttcctatcccaagaagtccaaaaagctgaagccatacaagggattaaggagagggagaggaaagtggcctatccatacaaatccagaatttggagaacgagacctattagagatcacgggtattgatatagtaagctaaattagcatctcttctgcccactcagggatagataggatgagtttaacacctttatttcaaaattgctatcaaatgtatcaaacatgcatgtgaggactctcaatataaagaactgacttggtggatcacgaggtcaggagttcaagatcagcctggccaacatggtgaaaccctgtctctactaaaaatacaaaaattagctgggcatggtgatgggcacctttaatctcagctactcaggaggctgaggcaggagaatcacttgaacccgggagaggaggttgcagtgagccgagattgtgccactgcactccagccttggcaacagggtgagaatccatctaaaaaaatataaacaaataaaaaataaaaaaaacaaagagctgacttgatgtggagccgtacttagtagtaggggacggtgactctatcttggtctttaaactttgaggaatgctgtaattcctaaatgactcccaattttgtttccttcctaaatttggaataatcaactcactgtcttcattccatgacacaggatagttctgcttctttggattctcagctcccaagggatttaaaattctcaggatccaattttggggttagttactacatggtctttgtagaaatatcaagagagagactcattgctcagggattatttgatatttcaatttgatatatgtttgcccacttgatagaaaggactaccagaagaacaggatatttacctggtgccaaagtaaaacctcgcaccttgttaaccaacttcaaaggcaaatgtaccaggtcagtggaattatctggctgtcagcatcataatcaaaccaatcattactaacagtgagacaggtcactgttgtgtatacccacgatgcgatctgagatacccaacatcacctatgaagatttttgccaaaaatgttgactcttaagtcaaatgagatctctctagatgtaacatctagaggggatagacaagttaaattacaacaagaagaaactatcagaaaaatccagaatgtgagataactggcatggatgtttaaaaagtcaatgttggctgggtgtagtggcccatgcctataatcccagcactttgggaggccgagggggtggatcacctgaggtcaggagttcgagaccagcctggccaacatggcaaaacccagtctctactaaaaatacaaaaattagcctggcatggtgccttgtgcctgtaatcccagttacttgggaggctgaggcaggagaatcgcttgaacccatgaggcggaggttgcagtgagccaagatcatgacactgtactccagcctgggcaacagggtgagactctgtctcaaaaaaaaaaaaagaaaagaaaaaaaagtcagtgtttttgggggaaaggaggaggggagagaagtattgtggattaaaagagacatacccaagtgtaatgcctgaaccatgattggatcctgtcttgaacaaaaaaggctacaaaatacatttttgtaataaatggggaaattttaccatttattatggtcagtattagatgatattatgactagatagtagatgatattatgaaattattgttaattttcttagatgtgatactagtattgtggttcacaggagaatgtccttacactagggagatgcaggctgatttcacgatgtctgcaacatattttcaaatggttcaatagcaataacaaagacaagtaaaatatacacatacatacaaatacggcaattactagatctgggtagaggataagaagttattcattgtactatctttaaaattttttcatgtatatgaaatttttctaataaaaagttggaggagaaaagttgataaagcaaaacccaaaaagtgcagtcaggtagctgtggtaacacttcagaaagatagccctttcttttcccagcctaatcaaatcttgccacacatttgtgaatttgtttttgcgtgagatcttatttatagtggaccataggaagggcttagtactgcccagacaccagtgattctgagacccttattgtgtaaacacattcattctatggagccaaaggagctctcctaatagaggcaggaataacaagaactagtgtatggctctgatttgtgcgtagcatgctctgttgttatatttaaagtacgactgctaaattcattatttgggaattgttacaagatgtggtttcaaacctttagaaaatagtatgatattattacaaagaatgcctaaaacaacctccattctgctttccagcctactatggcatatctttgtttcagctttctggcctggaaacctcttggtttgtggagacccatggaagagactcaaagttggcagatacttgaaactggcagatgatcccctcagccaggtctagggcttaccctttcaattcagggtgtggaatctgcttttggacacctggcattttccttagctgggcccagaaaactcattcagtttgactctttatgggttgcccagatgctgaccctaagcctatccagaaaccaggaatgttttactgtggtaaaagaattctggttaataaggaaacctagctattactcagctggaaaaaagccagacggcccaatcctgctaagagttagctgcatcactctctgtgacacttttctctgagtacatggaatacatgcgttaaggaaacccttgccttgtgaaactgctatttgtttgcttcagacaaaaaaaacttcggtactgcttccaaagtcggtactgaagggcagcagggagaggggctgcagaggaaaatgtcctttcagagcttattacctcacaggggagatggacgcacacacatctgcagagaagccatcagggacgccctcatcttcaaattgcctgtgcctttagtcccacgctctgtcttccttcctgtccacccctttctgaagccaaccatttcccttgcgtcctgaccccaccctggccttgttaaagacttgcttcttcaggtgtccttctctcctccctgcctcatttctcttttttttgcggggggtgggggtggctgggggagacagagtctcgctgtgtcgcccaggctggagtgcagtggctcaatcctgactcactgcaacctccgcctcccgggttcaagcgactctcctgcctcagcctcccgagtagctgggactacaggcgcccgccgcgaagcccggctaatttcttttgtattttagcagagacggggtttcaccgtgttgcccagtctggtctcgaactcccgagtttaggcaatccgcccacctcggcctcccaaagtgctggggttacaggcgtgagcaaccgcacccggcccctgcctcatctcttatctctgcggcaccattctcagtagccaccggggtctaatgacatctcgtctttaaaagtaacaggccgggtgcggcggctcacgcctgcaattccaacacgttcctgcagtctcagctactccgaggccggggcagggggagggctgtgggggttgtgggggaagaacggcttgagcccgggagttcaagactgcgatgagctatgattgcgccactgcactccagtctgggcaacggagtgagatcccgtctctaaaaaaacaaacaaaaaaaagataaagaaaaaaataagtgtacacctcaccccccagattcagtcgtcttctttcccttccagccgtggtcgcgttctctgctgctcctccagcaaagtgactgtcatcatctaaccgccgagcagtttccatccccgctcctcctccgaggctgctgttgtccatgtttccagggaccttgaagttgttggcttccatgggagcgtctttgtatttctcatgcttggcaggattcagtcagttccccactctcctccttcttgaaacaatttcttctcatattgcctgacagcaggctcttctggtttcctctccaccttaagagatgctgcctctcactctcctttgttcttccttctccatttgacttctagatgtcaggggccccatctgatgtccgtctacatactctcctggctgacctcatccaatcccatagctttcgatacctccatatcctgatgacttccaatcagtgtctccagccctgacatctccctggaattccagatttatagaaccaaccacctacttgattaatcaactgatagatttatttaattaaaacatttattattttttgagacagggtctcgctctctcgcccaggctggagtgcagtggcatgatcatggctcactgcagcctcaacttcccaggctcaagggatccttccacctcagcctcctgcgtggctgcaccaccacgcctggctagttttttgtgttttttgtagcgacagggtttcgccatgttgcccagattggtctcaaacacctgggctcaagtgatcccccttcctcagcctcccaaagtgctgggattacaggcaagagccgccacagctggttgatagatttattaattccatgaatatttatcgattacctataaatgccagatactattctaggtttggaggatacttacatcagttaaagacagatagcaatcactaccctggaaataatgaacatcataaataagtaaatcagacactatgttagaggctggtaagtacatagagaaaaattaagcaggggagacagatagtgagtgccaggaggagagggtactacagttttaaagaggatggagacagactgtcctactgagaaggtgacacttcagcaaagacttggaggaggtgaaggagtggcccgtgtggctcatttaaggaaataacagtggaggcagaaggtacagtaagtttcaagtcgctgtggcaggtatggctttgtgtgttcaagaaacagcaaggaagtgagtagagtgagggaagagtcgcaggacagaggatcagagaagaaacggagggtacaggtgcggatcccatggagcatggtcagccataggaaggactttggtttttataccaactgagatggagatctgccaacagttttaagcagaggagtgacataatttgtctaactttgtaaaagctctctttgcctgctttgttgagaatagcctctaagggacaaaggaagaagagctgggaggctattttagccgtttcaatgatgatagtgtcttggccccacgtagtagcagtgaagatatataacaaaaagcttcagatcgtggatatgttttgaaggtagagccaataatatttgctgacagaatggatatgggatgtgaaaaaaagagtgaaggaggacacaagtatctctggcctgagcaattggaaagatgaagttgctaccagttaggacaaagaagacagtgggttgaacatggttttgagtaaggttgctgggtttaacaacaaaaaatcaggaagtccagttaaatttgaatttcagcaaaacaacagacactttagtataagtacatcccatgcactattgcttatacttattatgtgctgttattctaaatttactgggcatcctttattttatctggcaatcctaatttgagaggaaagtttgagttgtgtgttagagatgttgagaaggcagttggatatataggactggatatcaaggtataagtctggcctggagattaaaatttgggagagaataataatatttaggtagcctataaagctatgagattagaagaaatccccaaaggagtgagaatggatagatgactggcccaggaaaggagctggggccctccaatgtgaagagattgagaggatgaggaaggagcagcagagaagagggaggagaaggagctagtatagtaggagagaaatcagtatgtctactctgacagagatcctgagggaagcagcaattggtacctacaactcctgacttctccacacgccccctctcaaattctgcttccccccctatactatctcaattcgggatagaactgcatctgtccaggaacaaagaccagagagacaggaattatttttaattctctttccatcactcttgtctgtgttcaatccaatagcaacttcggtctcctctcctttcaagacatgctctgaattcatccagttctcttcatctccaccactactaccacagctcagccctcatcatctttcagctcagctcctacaaagcctctgattcccttacagtcattctcaacatggcagtctgaaccatttaaatatgttatatgtatgtgtttgtgcatatatacacacatatatgatatacattatttttttttttcgagacggagtctcgctctgtcgcccaggctggagtgcagtggcgcgatattggcttactgtaagctctgcctcccgggttcacgtcattctcctgcctcagcatctcgagtagctgggactacaggtgcccgcctccaggcctggctaattttttgtatttttagtagagatggggtttcaccgtgttaaccaggctggtctcgagctcctgaccttgtgatccacccgccttggcctcccaaagtgctgggattacaggagtgagccatatccaagcccgaccaatataaatatttttaatatacatatacatacagtggaccctcgaacaacacagggctagggatgccagcccccacacagttgaaaatccacatataacttttgaatcctcaaaaatttaactactaggcctgacgtggtggctcacacctgtaatcccaacactttgggaggccaaggcaggaggattgcttgagttcaggagttcaagaccaccctgggcaacatagtgagacctcatctctgcttaaaaaaacaataaaaaaaaaaaataaaaaaaatagctggatgtagtgccacatgactgtagtcttggctacttgggaggctgaggtgggaggattgcttgagcccaggtggtcgaggctgtaatgaactatgatcatgccactgtcctccagcctgggtgacagagtgagaccctgtctcaaaaaaaaccccaaacaccccaaacttaactacgaatagcctactgttgaccaaaagatttaccaataacttaaacagttgattaacacatattttgtatatatattatgcaccatatttgcataataaattatagaaaagaaaatattttaaaaatcataatgaagagaaaatatatttactattcattaagtggaagtggatcatcataacggtcttcatcctcgtcagcttcatgttgagtaggctgaggaggaggatgaagaggaggggttggtcttattgtcccaggagtggcagaggtgggagaaaatctgcatataaatggacctgcatagtttgaacctttgttgttcaaggctcagctgcttgtatgtgtgtgtgtgtgtgtgtttgcgtgtgtgtgtgtgtgtgtgtgtgtgtgtgtgtgtgttgaggtaaaccctctgcttcaaatcttgcaatagcatttcactgtcagtgtcagtacaatgaagctgaaactcattaccatggtccctgttacctctgacttttccctgtaaccctctcccactcaccccctaggatttgaccacagtgtcttgattatgcagggataaccaaaggcgtctattttaatagtcccagcaaagaaagggggcatgacctggagcaatgggggtacataaatatcagagaaagctcagaaagagacacaacaaataggtattcctggctttctaccttattctttatgagtctcgattttaaatcacagataatgacgaattatctgaaaaggcttaaaggaaaacccgagtctgggtttgttgtgttgtgaagaaaaaagctttattggctcgtggttctgcaggctgtcaagaagcaggcaccagcatctgcttctggtgagggcctcaggaagcttccactcatggcagagggcaaagaggagcggcatcacgtggcaagagaggatggaagagagacagctagagagagtggagggaggtgccaggctctttttaataatcagctcttctggggtctaatagagggagagctcattcattaccatgagaacagcaccaagccatccatgagggatccactcccatgacccaaacatctcccaccaggccccacctccgacactgaaaccacactttaacaggagacttggtgggcctaacaaaccatatccaaactatagcaaccaggttgtgactgttgtctttcagaaatgaagaattgggggccgggtacagtggctcatacttgtaatcccagcactttgggaggcaaaggtggtggatcacttgaggtcaggagctcaggaccagcctggccaacatggcgtaaccctgtctctactaaaaatacaaaaattagccgagcatggtggtgtgtacctgtagttccaggtactcgggaggctgaggcgggaggatcacttgaacctgggaggtggaggttgcagtgagccaagatcatgccactgcactccagcctgggtgacagagcgagactccatctcaaaaaaaaaaaaaaaaaattgaagaactggctttctgttgattattctaaatggtggcagttgcttattgaaaaccacaaattctgaacagccatgttgtgagctcttcatttgtttgtagacacagaaattttagaaagaaaatgtagatgttggatacaaaatattgaaggaaagcagcaatcaggccgcaatctgctttttcccacctgcctgtagatcttctcaggttattgctatttagctttcatgagaaattacctgggcaatactaggtattattcagtcagtgtccacacaggcgtttgtgatcacaaggaaaaaatggcaaaaatgaattttgcttttgagacagggtcttgctacgttgcccaggctggccttgaactcctgtgctcaagctgtccttctgcctcagccttctgagtagctgggaatataggcatgtgccaccatgcccggctcaaaaatgcatcttaaataattttaaaagattgccctttagggtttgtccaaaaggatacacgagaaaccagaatcaatgcctgcctctagggaaggaaactaagggactggaggtcaagagtaggaagaggatttacttttactgtatatcttttcatgtattttgaattttatattgtgcttttgtactacctacttataaaaaaaattgactgggtgtggtgggaggctgaggcacttgggaggctgaggtgggaggatggtttgaagccaggagtttggaaccagcctgggcacatagtgagaccctgtctctacaaaaaatttaaaaaaaaattagataggcgtgatgacgctcgcctgcctgtggtcccagctactccggaggccgaggtgggtggatcacttgagcaggagtttgaggttgcagtaagctatgagtgtgccactgcactccagcctgggcgtgacagagtgagaccttatctctaaaaagaaaaagagattaatttttataaaatgacagcttaagaaggccagaaacaaatcttatttgtttatgttttctggaattacatatgtacatttaaaaaatttttcccagctatttgggaggctgaggcaggagaatcacttgaacccgggaggcagaggttgcagtgagtcgagctcatgccactgcattccagcctgggtgtgacagagtgagaccttatctctacaaagcaaaaagaaactaatttttataaaatgacagcttaagaaggccggaaacatcaaatcttatttgtttatgttttctggaatcacatatgcacatttaaaaaattttccccagctactcgggaggctgaggcaggagagtcacttgaacccaggaggcggaggttgcagtgagtcgagctcatgccactgcactccagcctagtcaacagagcaagactctgtctcaaaaaaaaaaaaaaaatatatatatatatatatatatatttttttttttttccaaaatgggaaaatggtttgcagattgtagaattatgtgcgtggccctgggcatagcactgggagcctgggactgagggcagtgatgcctgaccttggagctatccagacctgggcaggtcctgctgctaccgtgcattctactgctctcagctgtcaaacatgggaccacacggggtgatctctgtggccccctgcagctcagatactccatgaatgtcttcgcccatgcgtttcacaaagtggaaaagtatcttttgacctatgagaggagctgcttcaatcggtgttgctcatgaaatttcatctcaaagcctggctgagggcttgatttcagagctgagcccactgagccccaccagcttttcacacctgcgaggttggtggatttcttgatcagttgagactcgcacggctgccgcttgcttgtgatctacacgcctccacttgccaacccacatgggttgaatctgaatctgaatattaattccaccctcgggagccaacacatacggaaaatattaatgcttccttcaaatggaacttttttccctttagaaacagatttttaaaggagattctaggtactgtgctaccaaaagaaaaaaagtcatatttccaaatgtgcatcgcgtcattgtactgtaaagaaaaaaatagtgtttacttcagggaagaatgaaaaccaagtcaagctttttccgtcaacgctacaattgttagctttaacaaacagagcgtgctatctccttgaaacaaacccaagaacatcagtgtccatgggacccacgtgttgtttcatccctgccgagtctgctgggctgaaacacaagcctgggttcttcacctctgacccttacgagccttccagtgcattaatttcaagtgtggaacctgggccaacgctgctaaggccatatctagttaaaaatgtaaacacaaagtctctgagaccaggagggcacgttctcatggtaactgcgggctgcctttcttttctctctgaagtccttaactgcttaactgatgtgcaatggacgtgagggagtctccttaagggagggtctttccagaggcctttgaaggcatttacatttagaaatattatgcctatcaaaccatatctaatatttctgtctcttgttgcccgaagtctaacagtctaacaaatgtagtccatatagttaggcaatgctggttcctatgttcctttcccttttgctgtgtggggctggtttgtcctgatctagactcttaggtatgaaggaaaagagtgaagaggatttactctagcactgatgaggctaattgggataaagctcagaatacctcaattaaggggctcttcaagaggccggatttgttgcagacagcttcaagaatgtggaattcagccttctgcattccccttgcacagcccccgagcgccagaaggagaatccactggctcctcagggagggtggccatgcagagagcagctcagggctgtgtttgctcctgtcaaagccacagacctggcttgctggcttataagggattgggggcagccagaacaagggtgtttgagaaaggaatattcaagaggaaaaatctattcatacaaaaacccacacgttgtgcacatgtaccctaaaacttaaagtataataaaaaaaaatttttttaaagaatacaaacactcagagtatggcaggtgctttcctgtcgcccttggcaagaacccgttgggggccatgaagagtttggggtcctgaatgaccctctccccccactgttctccaattcctcttcttgtgaaaaacaaattgataagtaaaacagcagctctttccaacccaggcgcctccatgctctgtgaaagggactccagaaatatgagttttgggacggcacttttctgtttctttttacatgtcatcgtggaagtccctttcacctcccaggctgaggcacaggtccattttcccacagatctgattcttatgctagggtagggagcaaagccttgtcttgtgtattgaaagttatcttgctgctgtgctgaattcactgatggtgtgcacagcatgagctatcaattatacactaattatatgactgacttcattatctcccttctgaaaatatgcagtctgtcccaaacaattagcactgaattatttccctatattgtttcctaatttttccatatgttggttttcactcttcagccagactacacacctccggaaggcagagacggggacttgaagttctttgaactcaaaacatggcaatatttattggtcctaatactgtcactggcaaggttggtgttttagggaagagatgatagtgtaagtatcaactaatctgaattctttgggtgaaggctgagcaaaactgaaatagttttaagaagaaaaaaaacaaaactgcaggatgtttagttaatttgttcatcattcaagttcccagagaacagggatcacgtctgtctcttgcagtgttacatccccagcactcagcccacagtttcacaagcaacaaacactaacaattatttttaatgaatgagttaatgaatacatttcttgagcttctgttatgtctaggtcttgcgctaagtgaagatacaaagatagtcttctctcttcagaagctttcagtctggggaagaagaagaaaggcagaattgaaaacaattgctataaaatatgaaagatgcaactctgggtgcagtggcacatgcccgtaatcccagcactttgggaggccgaggcaggcggatcccctgaggtcaggagtttgagaccagcctggtcaacatggtgaaaccctgtctctgctaaaagtagaaaaattagccaggtgtggtggcgggcacctgtagtcccagctacttgaagggctgaggcaggagaatcgcttgaacctgggaggtggaggttacagtgagctgagattgcgccattgcactccagtctgcgcaacaagagcaaaactccatctcaaaaaaaaaataataataaaataaaataagaaaaatgctgtctgaattccattcaaagtgctttggattcagaggaggaagctgctgaccatttaggggagtcagagaaacttcatgtttaaaaacacaggcacaaaaacattggatggattttgaaggaagactaagcatttgccagctggaaaatgtgaagacattctaggcagagggaaccgctggggccaggtcagacagctgtgaaaggctgcattttctgggaaccctacagctgtcccgaaggctaacaaggtgttttgaggcaggtggatgaaataagacaagtaagttggggcatgtttgcaagggttttaggattgacacttgagacaatggggagctgtgaaagtttttagcagggaattgatgtgaatagatttggatttggagaaatcactgtggacagcgtagtgaggagactggaatgggagaaactggagtcgtccacctcagggtgatcgtggcaccttggattagaggccgtgggatgggggatggagggaagtggactaatttgagagctattcagaaagtagagtcattggaagaccaagtggctagtcggacgtggggaagtgggaggtaggaagacaggagtccagaataatttctagtttctagagtaaattaatcaagaacccagaataagcagcaggactggtgtgatggggaaaagaagttttcagttttgactgcaatgaaaacctcttttgcaaaagcagcgtcctctctgtttgtgctgacttgggatatgctgttctcgttcagactgcaggggaattccccactttgtggggagggaagagagatttccctgatgaggtcaggctaggacatgagtcgcatggggcagccattttggaaggaagacatttgtccacgtggaagctgtaattcaaaatgtggacttcagcaagaggaaacacctagctctctcttgaatccgggtttcaagaagcactcaccagatagctgcacatcagactgcaggtagattgcagcctgtaagactcagaggaggacatattttataagccaaataatgtagttatattgtatcatgtgctttttttgtttttcttagtcttgagcagagaattataaaaatactctagtcctactgttaactgtgctattatgtcttcgagaacataaaatgaatagtataattcttccttccttcaagccagtgagaaataataacaattaggggagatctctgcagcacatatgaatttgggacaaaggctctcttgtagagattctccccccatcgccagcattaaaagatgaggctttattttgttaaggtaggcatttatgttcttaaacagatatgttatttgagatgcctcggctacatcattcagaatgtctactagcaaataccatctcctgcctgccctcaactaaaaagaaataaaacatctacatcatttaacttatcttgccccagttctaaatactgacaagcttgtagtaaatggattgtcaaatgggtctccagccaccccacccagctaattttttaactttttgtagaaagggagtctccctatgttgcccaggttggtctcaaactcctggcctcaagtgatcttcccgcctcagcctcccaagtgcctcagcctcccactgtgcccggccagttttttatgagtaggtagtacaaaagcacaataaaatattcaatacacataaaaggagctgggcttggttgctcacgcctgtaatcccagcactttgggaggccaaggcaggcagattgcttaaggtcaagagtttgagatcagcctggccaacatggtgaaaccccgtctctgctaaaaatacaaaaattagccgggcgtggtggtggacgcctgtaatcccagctgcttgggacgctgagatgtgagaatcgcttgaacctgggaggcagagttgcagtgagccgagattgtgtcactgcactccagccagggcaacagagcgagactctgtctaaaaataaataaataagtaaataaataataaaataatatgcaataaaaataaatccccttccaactcttttttttttttttttcttaagatggagtctcactctgtcactcaggctggagtgcagtggcgccatctcagctcactgcaacctctgcctcctgggttcaagtgattctcctgcttcagcctactgagtaactgggattacaggcacatgccaccactcctggctaatggttgtttttttttttttcgtagagacagggtttccccatgttgaccaggctggttttgaactcttgacctcaagtgatctggcctcccaaagtgctgggattacaggtgtgagccactgcggctggcccccgttccaactcttgacctcttgtccctgggttcgtttccctagaggcaggcattgattctagtttcttgggtatccttttggacaaactgtaagggtgttcttagtctgttgagagaacccttatctaacaatgctaaccccatcccaacatactatcctttttctttttttttttttttttgaggtggagtttcactcttgttgcccaggctggagtgcaatagtgtgatctcagctcactgcaacctccgcctcccgggttcaagtggctctcctgcctcagcctcccgagtagctgggattacaggtgcctgccaccatcacgcctggctaattttttgtattttgagtagagatggggtttcaccatgttggccagactggtctcgaactcctgacttcaggcaatccacccgccttggccttccaaagtgctgggattacagacgtgagccacagttcctggtctgtctatgctttttctaaaaaatattttcaattgtgataaaatacacataacataaaaattactatctttgtatgtgtgtgtgaaactgggtctcactctgtcactcaggctagagtacagtggtgagatcatggctcacttcaacctccgcttccagggctccagcaatcctcccacctcagcctcccaagtaactgggcccacaggcatgcgccaccatgctcggccaatttttaaattttttgtagagattagatctaactctgttgcccagggtgatcttgaactcctggcctcaagacatcctcctgccttggcctcccaaagtgctcgggttacaggtgtgagccactgcgcccagctaccttacctgtttttaagcgtacagttcaatggtattcactacattcatattgctgtgtaaccatcaccaccattcatctccagagctcttgtcatcttacaaaactagacctttgtacacactaaacaataactccccattctctcatcctccagcccctagcaaccacgaatctcctttcctctctgtgaatttgactactctatgtacttcatataagtggacttgcacagtgtgtcgctttttgtaactagcttatttcactggcataatgtcctgaaggttgatccgtgttgcagcatgtggcagaatttccttctttttaaggatgaatactattccattgtgtgtacagagcacatattgtttattcattcacctgttgatggatgcttggtttgcttccaccttttggctattgtgaacaatgctccatgaacatgagtgcacatgtctattttttgctgtaatttttaaatatagcatttgtcatgcaggatatatgttatgtctgatatatgtattgtttgctacctctccctcccaactagaatctaactttttgagttcaggaattttgttttgttcacaggtgtatcctcaaaactcagagcagagtctggcatatggtaggtgctcaataaatattttgctgaatgaatggatagtggactaatagtcatgattccaccagagtttctgcactgaggtctattctattgccgaccatattgctaggtggaggaaagcttttttttgagagagagggtcttgctctgtcacccaggctggagggcagtggcgcaatcttggctcactgtagccttgacctcccaggctcaagcagtccttccacctcagccttccaagtaactggaactacaggcacatgccaccacacccagctattttttgtagagacagggtttcaccatgttgtccaggctgatctcaaactcctaagctcaagcggaacgcctgggccaagcgatctgcccacctcagcctctcagagtgcttggattacagtcatgagccactgcgtccagcctctggaggaaagcttttgaacaaagttttcagttaattgtctttcactttcctaatctctaaagtggtcatcagtctttttttttttctttttaaaaagttaagcaatttatttataaaagacaaataaatattatatatatttatggtacacaagtcacattttgctatccacatacattgtgaaatgattaaatcaagctagtttgcatatccatcaccagacatgcttattcttttcttgcagtgagaacatttaagatctattctcttagcaattttcaagtatgaaatacattatgagtaatcacagtcaccacgttgttcaatagatgtccagaacttattcatcctaactgatattttgtaccctgtcaccaacatctctccatctcctccccttacctccagcccctggtaaccactgttctactctctacttctatgagttcaatttctttagattccacatgtaagtgagatcatgcagtatttgtgttcctgtgcctggcttatttcacttagcataatgttctccatgttcattcatattgtcacaaatgacaggatatccttcttttttggctgaatagtattccattgtgcatatacaccaaattttctttatccattcatctgtcaatggacacataggttgattcaatatcttagccattgtgaaaatgctgcaatgtacgtgagaatgtagatttctgatttcatttcctttggatatatacacagtagtgggattgctagatcatatcgtagttctatttttagttttttgaggaacctccatactgttttccatatggctatactaatttgcattcccacctacggtgtagaaggcttcccctttctccacactcttgccaacacttatctttcatcttttttccatcctaaatgtgtgagatcatatctcatagtggttttaattggcatttccctgatgattatgaaaccaacccaatagtcccatagataattttatggataaacatagaaattgaccattctggtcttaaaatcagaaccttacatttgttttatctgagttccttcctctgaaaaccactttcagacctgtcgaaaaaaaatagcgaagaacaccagatcaccacatccagacaatgagatgtgggaccctcattcatcatgattactccctcgcccctctctagtttctgttttcttacacattgttacatttcttccctgctatataaacctctagttttagccggtcagggagaaggatatgagactgagctcccatctccttgactgcagcaccagattaaagcttcttcctcagcaatactcattgtctcagtgattggctttctgtgcagtgagcagcagggcccagtccaaacccctggtgttttggtaacaattaatgatgctgaccatctttccatacacctgttagctatttctatgtctttttggagaaatgtctatttgggtcctttgcctatctttaaaatgaggttacttgggtttttttttttgttttttttttttttgctatcgagttgagtttcccatatattttggggaacttatcagatgcatggtttgaaaatattttctcccactccacatgctttttcattttgttgattgtgcagaggtttttagtcagatggaatccttaaaatgggtgtcagtcttgctttcagcaatatttgtgaacatccctatgtgacaggtagctctgcctcagtcggccggcccagtcactgtattttctagcagaactctggccagctcactggaaggaaaagcggactccttgagtgtggcttccggggtttccttgctcgtttacttgttctaaaatgtgacagcttagtttcttcagttacattcattttaaattaaaaataaatttcccttgaactatgattcaatgatgtattttctcaaattattatcctaaatcataattaaatgaaactataatcataccaaaatcgagttatatcgtttccacatttaagtgagaatttatgtgtaaacttcctgtaaaaagttcacatcaattttactcaaaactatgagtcatgttgttcattctgaatgttatttttatgcattttcatgagtttattataatggctcatttacagaaggccttgaaagggactcaagtgaagtatgacttcttcaatttgcttatttgtactatttcatatttgtctccccgagtaggtaggtttattagaactagagagtctggaactggaaattctcatcaaaatgtgtacgcagggagcagtgaagagaggattcccttttgtaagaaattttaccctccttaaccttcttgatttgagtattaagagttaaaatatcttcctattttctgatagacaagcttctaatatgcacattatatttatgctctgggtgggtgtatcataaagaccacacatatttcttttcatagaactataaactggtaatttctgaaaatcataaagaaagacaatctttatgattttcagggccgggcatggtggctcatgcctgtaattccagcacttgggaggctgaggcaggggaatcacttgagctcagggtttgagaccagcctgggcaacatagcaagacctcgtctctgaaaagaaaaaaaaaaaggcaatttaaatgttattatatattgaaggaacacttcaatatataagaagtataatgctttggtgttgatgattggaaagcaaaagtactgcctctctgcactctacccctggctgtctgatccctaaccccaggtcagagctcctctcagggtggttctccctcaccactggctcctttctgttctggcaaatgctcttctccttgtctggttcacccagaggtggggctgcggtatctcttgcagtttctctataccttagccacacttctgtaaatagcctctttattaactcacatcaacatatccttatctgagcatgccctcttttctcctgttgggtctctgtttgacacacaaggtttaaccaaaggaaatgatttctgtaaatgagaaaatattttattaaacattgcaaaatatgcagactttctttgaaacattaggcaatacagtaacaaaaagatggaaaacaagagaaagaaagggtggagctggggaagagaagtaaagaaagaggggaaaacagccaggcgtggtggctcatgcctgtaatcccagcactttggaagggctaggtgggtggatctcctgaggtcaggagtttgagaccagcctggccaacatggtgaaaccttatctctactgaaaacacacaaaaaattagcgaggcgtgctggcacacaactgtaatcccagctactcgggaagctgaggcatgagaactgcttgaacttgggaggcagaggttacagtgagccaagatcatgccattgcactccagcctgggtgacagagtgagaccaaaaaaaaaaaaaaaaaggaaagaaagaaagagagagaaaggaaggaaggaaggagggaaaagaaagaaagaaagacagaaggaaggaaagaaaagaaaagaaagaaaaaggaaggaaggaaggaagggagagagaaggtaaatgaatacaagaagccttggctttttcagtgcaggagggactctgaagtcctaaagcaattgatgggggtgaaggtcgtcagatacagaagacatcatgacgccagctcccgtccactgaatgctctctgtagcctaaattctcgcctcagcttatacctgtgctgctgtattaggtagcacaagcccagggggcaggagagagctcagggagcgcagcggggaaggtagggcaaccatgaggaaggtgagttaccaatctggccactaccttggggtcaaacttgatcataggaaccatcttctaagacaatcactttttgggacaccatttaggggaggaagggggaagaattgatctctggagtttgtgcctgtgtgaagttggtaggagtccatgcagagctgatggctacagtgatggtctggcctgaggccccagatcaagagaggccaagagacctgaggagggatccgccatagtgccatcatacatgaacacgaatcctcacagtaaccctctgaattagccaggtgtgatggtgaacacctgtggtctcagcaactcaggaggctgaggcaggagaatggcttgagcccaggaatttgaggctgcactgagccataactgtgccactgctctccagcctgggcaacagagtgagaccctgtctctaaaaaaattaactataataatagtaaccctctgagcaggcataggactctgggtacgagtaatacagactcacttgggaagggaaaggccgtttcttggcacactgaccagacctcagaaagcgcaagggtgtggcagacctcagggctcactggaaccgaatgcttgaagggcagcaacgccccgcgcctccctgaattctctcagaatggtttccccttgattgggaaccaggatccctggcagccctgggtcctgccaccagaaactggaaaagaaagggtttctccttctcttagtctgaaggcatcccagggaagagccctgacctcactcttggtcaggtgacccctccttggaccactcagtgtagctggggggccgccctgtgcttggccactcctgggctgagtctgccctgcagcggagggtcggccgggtcactcagagctcaccagagtctgagttgttcaacgtcactagtaaggtcagagggggtcgttccattcatctccactcccagaaataagaggagcccacacaccaggcaggagaacagcagctgcggcaggccctccaataaggacgtcatgctgaagagaggaaaacgcttccctcaggccccgtcggtgggggctgcctgttctcactgccgcggggcttttctcccagggttctgggttcctcccgtgtcccaaagctgggcccattcgtttaactggcatgtctccatggtctcagcatgggtgagggtgtgtggttgaatgtgggtgagcgtgggtgaaagtgagtgttggcgagtgtgagaatgagtgtgagagagtgtgggtgagtgcgaggatgagtgtgagtgtgggtgagtgaggatgagtgtgagtgtgggtgagtgtgagagtgtgaggatgagtgtgagagtgtgaggatgagtgtgagtgtgaggatgagtgtgagtgtgaggatgagtgtgagtgtgaggatgagtgtgagtgtgggtgtgaggatgactgtgagagtgggtgagaggatgagtgtgagtgtggatgagtgtgaggatgagtgagagtgaggatgagtgtgagtgtgggtgagtgtgaggatgagtgtgagtgtgggtgagtgtgaggatgagtgtgagtgtgggtgtgaggatgagtgtgagtgtgtgtggtgtgaggatgagtgtgggtgagaggatgagtgtgtgtgggtgagtgcgaggatgagtgtgagagtgggggtgagtgtgaggatgagtgtgagtgtgggtgtgaggatgagtgtgagtgtggtgtgaggatgagtgtgagtgtgtgtggtgtgaggatgagtgtgggtgagaggatgagtgtgtgtgggtgagtgtgaggatgagtgtgagagtgggggtgagtgtgaggatgagtgtgagtgtgggtgagtgtgaggatgagtgtgagtgtgggtgtgaggatgagtgtgagtgtggtgtgaggatgagtgtgagtgtgtgtggtgtgaggatgagtgggtgagaggatgagtgtgtgtgggtgagtgtgaggatgagtgtgagagtgggggtgagtgtgaggatgagtgtgagtgtgggtgagtgtgaggatgagtgtgagtgtgggtgagtgtgaggatgagtgtgagtgtgggtgtgaggatgagtgtgagaaagtgggtgagcgtgggtgaaagcgagtgtgagtgtgggtgagcatgagaaagtgtgggtgagtgtaggtgagggtgagtgggtgacagtatgagtgagggtaagtgtgggtgactgggtgagggtgggtgtgggtatgagggtaagcatgggtgagggtgtgtgggtgggtgagggcgaggatctgggtgtgtgggtgagtgtgcatgagtgtgggtgtgggtgagtgtgtgggtgagtgtgggtgagagtgagggtgagtgtgagggtgagggtgtgggtgagggtgagtgtgggtgagtgagggtgtgggtgtatgggtgagggtgttagggtgagtgtgggggtgagtgtgggtgagggtgagtgaggatgtgggtgtgggtgaatgtgagtgtgggtgtgggtgagtctgaatgtgggtgtgggtgtgagtgggtgagggtgagtgtgaggatgagtgtgggtgagggtgagtgagagtgggtgaggtgtgggtgagggttgtgagggtgtgagggtaagggtgtgagtgcgggtgagtgagggtaagtgtggatggggagggtgtgtgagtgggtgtgggtgagtgtgagtacaggttagggtaagtgtggatgggggagggtgagcgtgagtgggtgtgggtgagtgtgggtgagtgtgagtgcaggtgagggtgtgtggatgggggagggtaagcgtgagtgggtgtgtgtgtgggtgggtgagtgtgagtgagtgcaggtgagtgagggtaagtgtggatggggagggtgagcgtgagtgggtgtgtgtgtgggggggtgagtgtgggtgagtgtgagtgagtgcaggtgagggtaagtgtgggtgaatgtgggtcaccctgcgatgggagggcatcctgaccggagcgggtcccacctggcatcctgaactgctgggatgcccctatttccccccacttccttttcccaccacccggacctgaaataaggggatacttcttacttgttttgattagttcttcttaaatatttgtatggctcacatttattacaatgtgtaacatgagaagtgttttggcctttatttagaactttgatgatatttttgtgatgggaaattatgccctaggaacttaactctggtttatatcaattaacctatgggaaaataggttttgttatctgtcgttttgcttaaagttgcagtttccaagaacctattgatggtgttaagtgaggatttaccgtattgtgtttacacatgtagccaaagtcaaccctttctacctcgcccagaagtatattacagggaacacattttgcactattttgtcttcatcactcacatataagcaattgccaactcttgtccatttctgtttcttaagtgtctcttgagccctccctcttcctctgctcattgccacaccacagtacccgcccgcaccctgtcagttggctgtttgcaatcaccagctggtctccttgcctctctcaccttgtccaccttatgctgtcaccagagttatcattgtaaaacaaatctgattgaaccattctgttcagaggtctctggtggcccactctttcttctgtatttaatatcaactctgtgaaacttccccagaaaggaagaatgaaagaatttgacttttcctgaaagaacctctctagtactttgtagtaaaaatactcttctgtttatataaactctcttagggtggctgggcttggcagctcacacctgtaatcccagcacgttgagggtctgaggagggaggatcatttgaggccaggagttcgagaccaacctgggcaacatagcgagacctcgtttctacaaaaagttttaaaattatctgggtgtggtggtgagaggctatatgtccccagctacctgggaggctgaggtggaaggattgcctgagcccagaagctgcaggctgcaggctgcagtgagctatgatcatgccacggcaccccagcctgagggatagcgtgagatcttatctcagaaaaaaaaaaaaaaaaaaagaaaacaaaacccccacaacactcttagggtatttatcatatttgattgtatgtttttgtttgtctgtgttagtttcctccaccaaatagacacttattcgaatgagcagaaacactttcttagttattattgtatccatagcacttgtcatgccctggtaatagacattcaataactgccaaataaataattaacatttagctttttcttttattccctggtgtctggagtaggggaagaagaaaaaaggggaaaaacaacagaaagagaaataggagagaaaaaaatccaaaattacatttaatccccgtctcttgtatcaaatcaattttggaatgaagtgaggatataaacaagtcagtcaacaaaatcatgacatttcatattagtaacacgcagtcttatctccagaccataatctgccctgatgtttgtagtttgtctcttggttccaaaacgcaatgttattgaaatgaggctgtggataataccgccgttggaaaaggcatgagggtcaatgcaaaaatgcagtgacggaagtagtacattgtgtgtgtcaacagtcattcaaattacagctgtccttggcatcctcaggggactggtcccaggaccctcgagaataccaaaatccttggatgctcatgccctgatataaaatggcgtggtatttgcatataacctatgcacattgtttcctatacttcttaaattttattttttattttttgagaccaagtcccactgtagcccaggctggagtgcaatgtcgcgatctcagctcactgcaagctctgcctcccgggctcaagcgcttctcttacctcagcctcccgagtagctgggactacaggcgcacgccataacacccggctaatttttgtgttttagtagagatggttttcaccatgttggccaggctggtctcaaactcctgacctcaggtgatacacccaccttagcctcccaaagtgttgggattacaggcatgagccaccgtgcctggcccttttctagaaatcatctctagattacttataatacctaatacaatgtaaatgctatgtaaatagttgttatactatattggtttttaaatttgtattattttttatttttttaattgttctttttccaaatatttttgatctgtggctagttgaatctgaagatgaggacctcaagaatacagagggctgactgcactgacaaaactcagtggaaacctctggaagatttgatggtagatggttttatcatctgcagctgttcactcctccactgtgtcagagaggattagacatccctgttcattgcaggtgacctcacatcacccccataaacgggggcaggttgtgcttccacaccttgttgtcagcccgggccaatggaatctgagcagatgtgacttacaccaggatgagcagaagcttcaatgtgattgcctgctgtgatggccaattttaggtgtcaacttgactgggctaagggatgcccagatagctggtaaaacatgcttgcagggtgtttccagaggaggtgagcctttgaattggtagctttagtaaagaaaatctaccctcattattgtgagtgggcatcattcaatctgttgagagctcaaatcgaataacaaaaaaagaagaaatggtgaatttgttcactctgcttgagccaggaactccatcttctcctgtccttggatatcagaactcttgagtctcaggctttcggaatcagacagggatttatatcaccagtcccctccaacctcccttctcagacccttggacttggactgaattacaccactggctttccctgttctccagtttgtagacagtggcatatgggatttctcaccctccataatggtgtgagccaattcctagacgaaatcatatatatgtatctatctctatatatcatatctatatccatatatcctatctctatatatcctatctatatatatgatctatctatctatctatctatctatctatctatctatctatctatctatgtttctctgaagagccctgattaatacacctgctttggcaaggacccttgctctgccccctatcgcagcctgtcccggatcagggctgcttctctggtggaggtcccagattgagaagacaccagaacagacctgccgcccaccggcggtctggagcagaagcacagtcccgggctgactgtggtagactcacatgtaacacaagcaagacatacacatggtttttattgtaagcaactgacatttttgtacctgtttgttactgaagcaaagctgataacttagagaagtaaatcaaaattcttaagtggaaacaaccagcaaaatacttttaaatatgaaccattaaaccaaattccaatagaagtaacagggaatttattgaagagagacaacattctttttgattgctggaaagaatagaatcttcaattaaacaaattagtaagcaaatccatgccacgtagtagattacactattactcccaattatttgttgcctttactatggaaaattatacttgcacacatcatttacatgaggcttggccatgtgacttgctttgatgagtaaaatgtgaatagaattgctgtatgcggctggacacggtgactcaggcctgtaatcccagcactttgggaggctgaggtgggcggatcacctgagatcgggagttcaagaccagcctggtcaacatgttgaaaccccatatctacaaaaatgcaaaaattaaccggcatgatggcgggtgcctataatcccagctactcgggtggctgaggcaggagaatcgcttgaaactgggaggcagaggttgcagtcagccgagatcgcgccatcgcactcctacagcctgggcgacagagcaagactctgtctaaaaaaaaaaaaaaaaaaaaaaaggattgatgtatgccacttctaaacaaaaactttaagtaggataatttgagcagaaaaggtttccaggaagtggagacgcagcaagggatggaaagtgctcagtgatatgcacctcgctttgttgaacttctcaagggtcggcgtcaccagaaagaggccctctggttagccatctaggggcctcatagtaggattcctttatggtattcttctcttagatgtgcacattcagaaacttcatctcattagtatgacatactgattaggtacacggagaaagaggctcatgctaatagaattcactagaggccagggtatcaatgggatcatcggtgttttactctgtgaactgcaatttcctttccagcactgaactgttcctttccgggtcctccgcggtacagagagcacgtattcctctctaacaaggtatccaggaagccgatgataaaatctcgcataaaagataagggagacagcatcccagccttgtaaagccggaacactgcctgtgtttcagggaaaccatttgatgtgtatccgtcagtcaccaaactttctgctgcacggagctaaatcatctcccagttctgctcctcagaccctgcccttttctgcgcttcactgttaaacattctcccttctcactgactctttaggtgagtttagagcagtcattggtttttcaatcacacatttgctcttttagcttctggcagatcttttgattcccaattcagagacagagtggaagaagcatggattctggagcgagacacatctgggtccagatccagcctgtaccactcactagctgtatgtttcttagtcattctgagccttgtatcttctactataaaaaaaaagggataatcgacatctcagggttgttgaaaggggaaaaaaagaaatcagattctaacctagctgtcacataacaaatgtaagattttcttattttctattgctatgaaaacatcatgcaaaataatcttaaaatggtaataaaaataacaactgtaataatacttattaagccctacgatgtcactagtactatgctagaaactttagtctttcgttaccattctttgtggaattaaaagttatcctttaatgcccttttcttctcctctctgctgttctatataaaccttcattttgtgtagaagctagaaattttctgcagctcagacagctcttgatgctgatgaaaaccttcatatcctattcctctctggtaattacaaagcctcttatctgcacaagtggattctttctgaagcatcatttccattatccctctgctctgattaagagttcacaatggttctttagcatatatcggattgagagattaacccctaactccccagtccctggtcagccttccaaccagttttctaggagaggcacctttcccgtctaactttccaccctgcctgtgcccatggctcactactggttccctttatgcaaactcggtttatgcttttcctctcctggaacaataattctttccctatttccagtcatctaaatcctacacttcttttaagatgaaatttgaagtccacaaaaccttctaagactaaccaaacctcaaatctctataattaatttttgttttgctttgaaaaaaattgttttttcaggtaaacaggacatatgccctcagctactgcaggttaatacctcaaagacaaggatattgtattccattactttgacgttttcctccatctctaggcctagccaggcctacgggaaagagtaggtgcttaatacttggtgaaatgaatcactgttataatgatcactatgccacgaaaccggccactacaaacacttcgtggacccccgaagatttcacctcagtctgtgaagaaacatttgcttaattgatatatactatacatagggttaattttgttttaaaattcatgcatttttcaaaagtcagcttactcaagaagagtccaggaatttgcaattaaagctacgtaaggatgattaaaatgtgggtagtaggctgggccaggtggcttatacctgtaaaaccagcattttgggaggctgaagtgggtggatcacctgaggtcaggagttcaagaccagcctgaccaatatggtgacaccccatctttactaaaaataccaaattagccaggcgtggtggtgggtgcctgtaatcccagctacttgggaggctgaggcaggggaatcgcttgaacccagtaggtggaggttgcagtgagtagagatcgtgccattgtactccaccctgggggacaagagcaaagcgaaactctgtctcaaaaagaaaaagtcaaaaaaaaaaaagtatatatgggtagttggctgggtgcagtggctcacgcctgtaatcccagcactttgggaggccgaggcaggtggatcacctgaggtcaggagttcgagaccagcctggccaatatggtgaaaccctgtctctactaaaaatacaaaaattagccagacatggtggtgcgcacctgtaatcccaattactctggaggctaaggcaggagaattgcttgaacccggaaggcggaggttgcagtgagccgagattgcatgtttgcactccagcctgggcggcagggtgagactctgtctcaaaaataaaaataaaaatataaaaagtggatagttaaagaagaaccatgtaatgaaggagggagataattgtacagtttagtctccaggtgggtggaaggtttacctttccgagtgtgaacttttctgtcttttggaacttaaaataattgcatatgaatatgatcatgcacaaaatgagaatgacatccaagcaaggtgtttttcagtaacctctaccattgttctttgtatcttaaaaaagcaatacattatatggcttgtttgttaattgaaatataagcaagaagaaagcaagccagatgcagtggctcatgcctgtaatcccagctctttgggaggccaaggcgagcggatcacctgaggtcaggagttcgagaccagcctggccgacatggtgaagctgtgtctctactaagggtacaaaaattagccgggggtggtagtgggcacctgtaatcccagctacttgggaggctgaggcaggagaattacgacattgcactccagcctgggtgacaagagcaaaactccgtctcaagggaaaaaaaaaaaaaaagaagtacaaagcacataatcacttaacataccttcttctgtgtgccaacttagataaatggaggcaacagtagttaatgaacatctggaagaggctgaggaaaaaaaaaaaacagtggcagtctggaattttcctggagctcattgtgggacaaaaccaagcagcatgaataaaatcttcatcattcacacacttctgtgattttacagcatggcagggacagacacacaagtgtgtgtggcctgagtgcttcttgaactcaaggattcctgtgccaggatccgtagctgagcccaacatttcgctgtgacttcatggcagtcaaagagggatgatgatttatgtgtctgttgttatctgacattttaagaagtcaccagttctttaggagatgaattcgttctccagtataaaagtgtaagagaagctgatcccgggatactgaaaagctaaggcagggtaagtcttcaatggaaatttcaaaaacatatggcctctcttgtggagagacaggaacatacggttccaagagaattctgtaaaatattttcacagggagctaaagtgacttaatctatatcactttctgatatagcaatattaaaaggtcatgaggaaaatgtaggtgggttattttattttatttttgagacagggtcttgctctgtctcccaggctagagtgcaatggcacgatctcagctcactgcagcctccacctcctgggctcaagcaaccctctcacctcaatgtcccgagcagctgggactgcaggcatgcaccaggatgtctgcctaatttttttttttttttttttgtagagataggggtctcactatgttgcccatgttgatcttgaactctggctcaaatgatccccccacctcagcctcccaaagtgctgggattacagacataaaccatggtgccaagtctgtttttatttttttcgtttttaattgttttcttagtccaggttccaggcttattgtttttattttttaaagatgaaaacagtgaaagtatggctcaaaacagtttcaggaagtcaagttaacaaagccattaaaactttttctaatcttttcctttgttctgttttggtttatttgtcgattaaaaagtaacttactgatgtgacattttgttactgtaaataagttcatatttttcaaacactaaattcttccatggtgtttgctgctagatatgagctagttgtctattcctgcactgctatttgcctcagtgaatcccagcactttgggaggcccaggcaggaggatcacaaggtcaggagttcaagaccagcctggccaacacagtgaaatcccgtctctactaaaaatacaaaaaattagccaggcctggtggcgggtgcctgtaatcccagctacttgggaggctgaagcaggacctgaacctgggaggtggaggttgcagtgagcagagatcgtgccactgcactccagcctgggcaacaatgcaagactccgtctcaaacacacacacaaacacacaaacacacacacacacacacacacacaagctctcccaggcttcagctgaggggcgcactgggagatgacggcctgtctgggccaaactgtttctgtaatttgtcttcctttcctcctcgggcttcacgttcccagtgagaccctctctgttgctttgcctctactgcgtccagtctgggccacaggaatgcgctattccgctttgaacttgaacccaagcctggccaaaactatctttttttggctcccctgagcattcattgccttcactcatttggcgacagttaatgcagcatctttgcttggtcctctcctgggtcctgagcagcagggatgaatgaggcagacaaaattctttccctaaaggagctgtccctttagtgggagaagacagaataaacacatacagaggaaaaagagctattgttagtcattaataccaataagacactgttcagtgtttccaagagcttgcatacatcaagggagaataagaagtaattatagaagacacaaataacaaggtatttacgcatgttaccaagcacaggttgttcattttaaaatgactaagctctagcttcagagtgggcactttgcccccaacctctttctactaagcaatctcagccaccttgctgtggagctctcaatagctgttctaattcttgtcttgtctcctagactcaacatttttctgttttcaaacgtcattgccaagaagccctcaatttcaaatgagtcactgacccagtaaattacctaatgcgtctacagctccacccaccttcgcagtctcagaatgctcaagtggaaaacgttgcttggggcaggtgactccttaggacttggaaatgagggaaatgtggttgcttccaccataaaatcggaaattccaagggggcacaatagagatgtgccaatctggggaaagactcttaggctggttaaaggccctaataacctaatagaagatgttggcttatctaaattatgtgtcactgtaatatgggggttggttggcaaaaaaggaccaaaatagtagagtctgaaaggctggggctggtggtgcccttgtggacagggtgcaggggcttcactggcaggtgtacccaccaactatagaaatgaagaaattgggcagttagagccatatgttactaaacattcaaatgataacttccctttctctgaatctatgctcatcaagaaatattatgtgattgactttccaaatcttcagggaaaataaggtaggtcttatgaattctgggcccacttgtcagttttatttcttatggaaacaaatatattggaatttccattactagaattcaatgtcttatcagcattttccccaaatctgatcaattttctttttttttttttttttgagaaaaggtctcgttctgtcacccaggctggagtgcagtggcatgatctcagctcactgcaacctctgcctcccgggctcaagcaatcctcccaccttagcttcctgagtagctgggaccacacgtgcacaccaccatgcccaggtaacttttgtattttttttaaagaaagggtttcgccatgtagcccaggcttgtcttgaactcctgggctcaagggatccgcccacctcatccttccaaggtggttcaatgacaaggtgtgagccatcgcgcctggcccgcgtttcattttctaagtcccaaaaagctgtgggctgcattaggaattcgtttgatcattcattcattcaattgaatattttcagaaacttgttacagcccaaccgctgtgcttaggagtatagcactgagcagaacagactgaccctgacaaccgattgctctaacctgtcttccctttcctccttgggcttcactttcccagtgagactttctctgttaccttgcctctatcacctccaatctggggcacagcaacacgctattctgctttgaactcaagcccaagcctggccaaaactgtctttctttggctcccctgagcatttgttgccttcactcatttggccaagttaacgcagcatctttgctgggtcctctcctgggtcctgagcagcaaggatgaatgaaacagacaaaattcttcccctaaaggagctgtccctttagtgggagaaggcagaataaacacatacacaggaaagagagctactgttagtccttattagatagtcacaatatttgaaccttcaagctcatttgtgctttcacgcaaataggtgcaataaagtgtgacaaggatttctttttcttttttcttttctttctttctttttttgagatggagtctcactctgttgcctgggctggagtgcagtggcatgatctcagctcactgcaacctctgcctcccgggttcaagccattctcttgcctcagcctcccaagtaggtgggattacaggtgccctccactacgcccagctaattttttgtatttttaatagagacggggtttcatcatgttggcccggctggtctcaaactcctgacctcgtgatttgcccgcctcggcctcacagagtgctgggagccaccgcgcccggccgacaagggtttcttgactttgatgtttgaaggaaggaaaaggtggggtctagaagaaacagctgggttcaggaaggctttctggagtaaacagtatctaaacagcaacctgctttaggagtttgcccagtgaatagggtagaaagaagagaagagaatggaggaaatgagggaaggaggagagcagggtgagatgaaagcatcccagagaagtccaggcaggcaggcacctaagtgctagggaaagtgagacagagggcaggcgaggggccttgcggccaaggttctagaagtttgggctctattctcagagcagtccagagccactgcacagcttagcgtgaactagcatgatcagatttgcatctgggacaaatctctggctgtgcagctgctgaattagggaggagtggagggccggcatgggcagagaggcaggtgtgatctgtgtgagcgacgatggtggccctaggcagaaacagggattgagagagaggtgaaagaatttgaaagacgtttcagaggcggaactgagaggacttgtggatggatcagtatggataagtatggatgggtgtgagggagatggaagaatgcaggaagatttctgggctgctgcctcaggccactgagtgggtggaaagggaacgtcctgacttggatcctggtcttctatttagacttttcttgagcatacacaaaaggagaggctggacacagcggctcacgcctataatcccggcactttgggaggctgaggcaggtggatgcttgagcccaggagttagaggctgctgtgatcatgccactgcattctatctagcctgggcgacagagcaagaccctgtccctttaaaaagaaaaaggagagagatgtgcttatatgaagagaaaggtcatctcccacaagagtacacagagcaaagagaaaagctgaagatggaaatgaccggcacattttaggactctcctaaacttcgtcagtgaagaaactgctatactatttcgaatggaacacctggagaaagatcaccagctgcttccccaccaccagctcctcaggactccaggagacagaaacctaatagcaagagatcaaataataaacattggtgcaattaaaatattttctttcatttctgtctttgtttctctttatattcatattcctcccagaatggttgtcttcaaaattcattatcttccttctttgttatttcattgaatttcttactgtatcagcctgtattagtcagggttctccagagaaacagagcctgtaggagatatacaggtatataagaggagacctatcatgggaaattacttacatgattatggaggtcaaaaagttaaacaggccaggcgcggtggcttacgtctgtaatcccagcactttgagaggccggcgggggggtggatcatctggggtcaggagttcgagaccagcctgaccaacatggtgaaaccctgtctctactaaaaatacaaaaattaggtgggcgtggtggcaggcacctgtaatcccagctactcaggaggctgaggcaggagaatcgcttgaacccgggaggtggaggtcgcagtgagccatcacaccattgcatgccagcctgggcgacaagagcaaaactccgtctcaaaaaaaaaaaaaaaaaaaagtttgataatctgctgtctgtaaactggagaccaggaaagcccgtggtgtaattcccagtttgaggccaaaggcgtgagaaccagagggccactggtgtaagtccgaaagcccaggaatgatgagctccaatatccaagagaaggagaagatggatgttccagctccaggaaagagagaattcacccttcctctgccttttgttccattcaggctcccagcagatgggatgatgcccacctctgttagcgagcgggatcttctttactcagtccaccaattcaaatgccaacctctttgcagaagagaaatgtcctcgcagacacacccagaaacaagatttcactagctacctgggcatccattaccctagaccagtcaacacatgaaattaaccgtcacgcagccttcggttggtctcacacagtccgttacaagactacatggatactttgcttttgggcactcaagctcttgagtttatctaacattctgaacttgggccgggcgtggtggctcacgcctgtaatcccagcactttgggaggctgaggcaggcagatcacgaggtcaggagatcgagaccatcctggccaacatggtgaaaccccgtctctactaaaatacaaaaaattagccgggcgtggtggtgtgcgcctgtagtcccagctatgtgggaggctgaggcaggagaatcgcttgaacctgggaggcagaggttgcagtgagccgagatcctgctactgcacttcaggctggagacagagcaagactccatctaaaaaaaaaaaaaaaaaaaaattatgagtctgattttgaatactgtctatctccttaattgcccatgaagtattgggcaattaatactcccttattccccatgaattattgaattctgcacacttttagctaacccttccagcagcccaccttgcaaaggccgctatgttaatgctgcagttttttctgtgtacccttatcagcattccaaatactcgtactagatattagtattttggagggggtgggttcatggattaactggcttcagccagtctagtacattttaattgtaaagaaaaaaataattagattcagttatgttaacttttctcttggatttgaattcgatgttcaagcatgatgaaaggaaaatatagatgataaaatatatgtaggaaaattatcatgatgtccatattaaaagtaaccatcaagaaagattctggaattatttaataagcttttggcagtctttccattaggcctgtgaaaagaggcgtttataaatgaataatcaccaatcttcaatggactcccagctctgcctggaagtcttaatatatttctctggttcactccctttctttctctattggacaacagttctgaaactttcctgctttcctcaaacctctaatccttttacctcccttctcacccttagcttcttagggtaaaatgaagccaacagccaagaactctctcgatttcttttaaattaatggcaaaaatctcaattacttttgcaccaacctggcacttgcacctagtctctctgtgctttctgttacattaggagatgttctttcttcctgacctgtgggaggtcttcctgaccgcttttgcagttatctcttcgctcctctgtggcttcaaactatccctttcaactgattctttccatggcatcctcatgtccctctcatcttaaacctaacaaaaccaaaaactatgccatgatttgcactccctccagcaacctccacctttctcttctctcctttatgactaaatttagtgaaagctgtgtatagatttatgatttttatctcctcacttctcattgcccaatccactcccatcacaccagtgtagtttacggcgggatctccagtgctctcaacatcattccacactcactttacctaatctctaaacagcatttagcacatcatcaacttattttccttcttgagacattcatccttttaccattaaatatcagaattacctaatgctttgtccgaagctctgttctccttctatacttttcttttttttttgagacaaagtctcactctgtcacccaggctggagtgcagtggcgcaatctccgctcactgcaagctctgcctcccgggttcaagcgattctcatgcctcagcctcccgagtagttgggattacaggcgcccaccaccatgcagggctaatttttgtattttagtagagatgcagtttcaccatgttggccagactggtctcaaacttctgacctcaggtgatccacctgcctcggcctcccaaagtgctgggattacaggcatgagccattgtgcccggccaatactcttcttgagatttctagatctccattcatctgagctctgctgatagattcaatcattatccatatgacaacttccaaattaacattgctagcccaagcttctattctcaactccacatcttctccacttggatgtctcagaagtttcttgtagccaggtgcaggggctcatgcctctaatcccagcatttgagaggctgaggtgagcagatcacttgagtccaagagttcaagggcagcctgggcaacatagcaagaccccatctctacaatagatatttaatacaaagacaaagttgctcaagctcaacatgttcaggattgaatttgttgtcttctagctaaaaactggtccacttcgatggttccctatctcagggaatggaaccaccatgcaggtcacaagcaggaccctcgctgttgtctccaactattgcctgtcttcaccttccacactcagtacaacacaattctactgctttaacctcctaaataggtcttaaatttttctccacgttcacactctagtctaaacaacttctaaggatcttcagtgaaaccaggtagcccttggattttttgaggtccccctcccttctaccctcatatttaactagtaccagtggtgatggatttccataggatctaataatgaaccgtgggataacaataaaatgattacctaatacattgtgagccaaataaaaatttgtaaacctacagtatctaaattcttacattatttgtggttggtttctacttaaattgtattctggatgaggctgacatttgaaaaaaaattcggtgtgcaattgacaacaattaattatttaacggcaagtgatgaggatcgtaaaagattaaaatagcctgaaaatagtacacagagcagatattttaaaagggcatgcacgggccaggcgcagtggctcacgcctgtaatcctagcactttgggaggccgaggcgggcggatcacgaggtcaggagatcgagaccatcctggctaatacagtgaaaccccgtctctactaaaaatacaaaaaactagcccagcgtggtgtcgggcgcctgtagtcccagctactccggaggctgaggcaggagaatggcgtgaacccgggaggtggagcttgcagtgagccgagatcgcgcccctgcactccagcctgggcgacagagtgagactccgtctcaaagataaataaataaataaaaaggacacgcatgaaacaacaaaaggtgattgcaaaatcctattttacataaattcaatttaaagctaagagaaaaataaatactaaataaaaaacatttcagaggaaaacctctcatgaagccaggtcgaatgagaaagtctgtttattcaaaggttcctcatcaagcgacacgctcaccctctacaaggagcacacacacatggtcttttcatatctcaaagtgctctcctggagagaggccaccaaaggtataggaggagtttcaacatgacaaaactctctcttccagaagtacagcctgagctcttcactctcacaaacagcggccactcatgagtcaccatggcaacagcctctgtaatggttagtgcatgcctcttagaaaacgatgtcgctcaaggtcaaagtctgcatttgtgaaaaagtctcactgtgttcccctgcacagacttgtcattgaacagcagccaaaacttgaggctcctcaaccttgaggctgtcggccaagtggccctgctagcttccctcccctgagtcctgccagcacttcctgtttctgttcctcctaccttggaacacctgggttcctccctttcctggaaagcatgctgctggggacagagttgggatgcatagccgggaaactcttccacttagtctatacatcattgagcatgcagtgctgggggctcctgctgtaagcctccgttgtgaacaaagtcttgggaggagccctgcttccccgggacgggagcaaacctaccaagcatgagctgaggagaagccacctcctgggcgttcttccaggtcatctcctatggccggggtctctaaacgtgtttgactgcacatccctatcagcacaaaatttttgagtatgtactcccaatatatttacttataaattatatataattatatgctgaaatctatatactacatttttgtaaagcttaatacttttttctcttttttttctttttgagacaggatctcattctgttgcccaggctggagtgcaacggctggatcacagctcactgcagcctcgacctcccatgctcaagtgatccttctgcctcagtctcccaagtagctggaactgcaggcgcccatcaccaccccgggctaatttttgtattttttgcagtaacggggtttcaccatgttgcccaggctgatcttgagctctaggactcaagtgttctggccacctcggcctcccaaattgctgagattacaggcatgcacccagccaatactttcctttcttttctggtaaattagtacatctcctatattcttcccaccttcaacagactgctttgcacacctcatgggttgctcacattgcactttgaggatctttgctatttactttcacaaggctcaatgttctaaaatagttctaaaatacagatctctccctgcttataactcttcagtggcacctcattgctctcaggataaagtttagactctttaacatggacttcctgtgggttgaaaatcagtctgactctgatctcaccactttaccagcccacagtttaaaactctagtacttgcattctttctaggtcatacgttttctcccatccaagactttgcacagactatagaaatcctttctccccacacagtctttccccctgactcttatttttaggaaattccctggaattcttcctctacctcctacctcattaggatgaagaccccaccatgtttctccaacacagcaggctttattctttatgcaatacacattatagtctattgcaattgtaaatttagtattgagcttgctaaaggttgggatggctttttaaattaaatggcctgggtttagcgaggttaaaaaggtgaagaatttcctgatttgagatggcatgccacacagcccagagcttgtgtctctttccttaccaaggagataccagctctggttctgggaaatgagcagaatggggtgttcctctccttctccctgtcttctttcttcccatggtatctaggccagatcgtggtctagtggcagagttttttggatttgctggtatgattcatggtaagaaatgaattttataacagactcagtacacacatagacatatacacatgcaggtgcgcacacacacacatacatatacacacacatacgttacacatgtattagtgtgttctcacattgccataaagagatacctgatactgggtaatttataaaggaaagaggtttaattggctcaccgttctacaggctgtacaggaagcatagcagcttcagcttttggggaggcctcaggaaacttacaatcatagtggaaggcaaatgggggagcaggaacatcttacatggctggagaaggaggaagagggagagggaggaggtactacacacttttaaacaaccagatctcacgataactcactcactcactgttgccatgacagcaccaagggggatggtgttaagccaggagaagccacccccatgatctcatcacttcccacctggccccacctacaacactggggattacaattcgacataagatttgggtggagacacagatccaaaccatatcaatacatatgtatgcacacatcatttgtttactattgtctcaagtacgcttacctatttaccttatttacagttgcaactcacccctaccactcttgaacctccttatattgccctgtttttccttttcccattgaacctttgagtatactaaattcttgattttactacgtttatttttatggtctggatccctccgctagactgttagctccggagaacaggggtctttgttttcttcattcatgtgtcaagttccccaaacagttcctggcacatcataggcccccaaagactatttgttgtacaaatgaatcagtgaattgaaataaatgtttcatgaaatctatgcttactacgtggaatacatacacatattttctcatctcatctattaaaaaaaaaaaagctggccaagatctactaatgggtcaaaacctgcagtttaataagcactggcttaggtattaagacccatgtcagggggccctgatgtggctggtgggaagataccttgtgggccaggagccttcccaattgatgctgcagaacttagcagtagagtctgggtgtgagggaggtcaggaggaactgctgtagaaaagtgtatccaacaaaggttgtggcagttttaaaatatgcccctgaactctttgagttgaaaatatgagtttaaaatacgctcctgtcttcaaaaggtggagcctaatttccctccccttgagtggggactggacttggtaactcacttccaatgaatagagtgtggtgaaagtgggcatgtgtggcttccaagaccaggttaagaaaggtggtgtggctttctctctgctctctcttttggatcacctactgtgggggaagccagctgctatgcagtgaggacactcaagcagccctgtggagaggcccatatggtaaagaactaaggcctcctgccaacagccatgtcagtgagccctcttggaagtgaatcttctagccccagtcaagccttcagatgacattttgtttgtaacctcatgaaaaaacctgagtcacaaccatccaaccaaaccactcccaaatttttgaccccagaagctgtgagataataaatgtctgttgttttaagccactaagtttcggagtagtttgttatgcagaaatggataacaaatacaagtgcaagctattttattttattttattttaaaatggagtctcactctgtcacccaggttggagtgcagtggcacaatcttggctcactgcagcctctgcctcccaggttcaagcgattctcctgcctcagcctcctgagtagctgggattgcaggcgcacaccaccacgcccagctaatttttgtatttttagtagagacggggtttcaccatgttggcaattttaaaaagggtttattcttatataattttaggtttaacttaattggcacacatactttcttaacctcaacttggaactgcagggtcttttcatactgtcaggcaatggtctagtgagagttcctgcaagagaggtagatgtctcttcctgaatcacagtgagcaaatttccagtcatgtgagtacattctataaaacatacttgtaggagaatagtggtgtacgcacagtggtgctgatgtggtgggggggcagtggaaggtgggggttatgaatttaacgtaactaaaagagcaagaatgagctgacttccatcgtggctaacacggtgaaaccccgtctctactaaaaatacaaaaaaattagccgggcatggtggtgggcgcctgtagtcccagctactccggaggctgaggcaggagaatggcgtgaacccgggaggcggagcttgcagtgagacaggatcgcgccacagcactccagcctgggcgacagagccagactccgcctcaaaaaaaaaaaaaaaaaaaaaaaaaaaaaggaagaagaatgagctgacccgtgagagaggatatctaggcactgtcatttctcaggcagagcttggttctcacccagagtttagactctgaaaatgttattaaatggcaaaacttgcagaatagctttggtctggttctcttaataattccctaactactaataattcttttttccccttagacttataaattacatatccaccatgacccacatttctaagcctgtatgaacaagtttcatcattcatgtgagcagaaggcttagctcacattgggagctaatgctgaccagagttccccactccaccgcaccctccgcaaggcagaactgaacatgtaagatattagcactgcatattttccccgataataaaaatattgactttatacttgtatattgctgaaggttttcttgtccactattctaccatcaatcatttagtactgcactgtcctatacagtagccaggagccacatatgactgttgagtacctgtaatgtgaccagtccaagttcacatgtgctgaaagtataaaatacgctccagattgtgaagacttagaataaagaaagtaaaatagttcattaataatgtttatattaactgtatgtagagaaacgatactatttggatataatggatgaaataaaactctaaaattaattttacttaatttctttttgcttttccaaacacggcggcgaaaaggtttaccatttcgtgtgcggctcacatattcctgttcgacagcgtggactggaagctggcctagggtcttttagcaccaattccttgcccaggtatttcggtgagaacacttgatcacatccacaccacgtgggttcctccgtgtagcttcacaatcttgctgaaatgttgtccaagtgagcaaccgtgtgtctgtaggattagggctgatgactggctcctgatcacagcctaccctggtgtgggaaggtggctgcagaaggggttaccggacatgctacaagtcctgcagcttctcactaggggaacggaattaaactccagggcctgtgcctgcagaaggccaaggacgttcattccactccactgaaattatagctctaaccttgagcagaaaatgtcattgtcagaagaaataagattaggggatcaacagtgaaaaacatcaactacaaactttttaatgttaagattccagggttaaaattctatttccccatcaccatttgtctacatagctggtatttcctcggcccacacatgacaagtctcttgtggcttgactctgaaagtttttacatactttgccttccatttagttagaggggattttgtttcactttaatcatttggtgacttgtagagtcgtgagttcctgtcataatcaaattaatggattagtattatctcttcaaagcaatgcaaaaaataatgtacaggcatgtgccgtacaatgatatttcagtcaatgacaaactgcatgaacgatggtgggtctataagattataaaggggctgaaaaattcctattgcctagtgacatcatagctaccagattcattgtcacatggtagtgccatgcattgctcacatgttgttgtgaatactgggctgccagtcatataaaagcatcgcacatacaagtatgtacagtacgtaatacttgatgataataagtgactattttactggtttatgtatttactaaactatactttttatcattattttagagcatactccatctacttattaaaaaaagttaagtaaaactcaggcaggtccttcaggaggtatccggacgaaagcattgttatcacaggagacgacagctccatgcctgttacttcccctgaagaccttccagtggcacaagatgtgaagatggaagacagtgatactcatgatcctaccctgtgtaggcctaggctaatgtgtgtgtttgtgtcttcgtttttcaccaaaaaatgtttaaaaagtaaaagataaataaataaaagttaaaaacagaaaagaacttagagactaaggatataaagaaagaaaatatgtatatatatgtagccgtacaatgtgtttgtgttttaagctgtgttattacaaaagagtcaaaatatttttttaaaaaagtttatgaagtaaaaacattacagtaagctaaggttaatttattgttgaagaaagacattttaaaaataaatttagtggctgggtgcagtggctcatgcctgtaatcccagctctttgggaggccaaggcgggtggatcacctgaggtcaggagttcgagaccagcctggccaacatggcaaaaccccgtctctactaaaaatacaaaaattagctgggtgtggtggcacgcacgtgtagtcccagctacttggaaggctgaggcagtagaattgcttgaacccaggaggcggaggttgcagtgagtcaagatcacgccactgcactccagcctgagcaacagaatgagactctgtctcaagaaaaaaaaaaattagtgtagcctaagtgtacagtgtttataaagtctatagtggtgtgcagcaacgtcctaggccttcacattcactcaccattcactcactgacttacccagtgcaacttccagttctgcaagctttattcatagtaagtgccccatatatgtgtaccattttaaatattttatgctgtacttttaatgtgccttttctatgtttagatacacaaatacttaccattgtgttacaattgcctacaatattcagtatagtaacctgctgtacagatttgcagccaatagtctataccatacagcctaggtatacagtgggctataccatttagagttaagtacgctctttgatgttttcacaacaacaaaatcacctaatgacacgtttctcagaatgtacccccaccattagctgatgtgtgattgtagagggaaatttcgtgtttggactgtgtgtttatttttcccccaagtcattttttctcctaatgaaccctgtgtatttaaattacagtctaccaaataaggtagctttatttctatttctaatttctccctctgtgatttcccaataaagatttagtacttgtcatttgcattttaattaggccctgttcctggttgtggcagatcagttttgcctggaggtttgatgcattccttgactgtgctctctgttacctgtactctgtcatttttatttcctcttgttctgtctgtcatgaaggcatgtgatagagagatagtgtcctcaaatgataaaaagataagtggctgtgatagaactatttacctaccatcctgttaaagtttcagagctagtcttgaatgttttgtctgtgcactgaaaaacaatgtatactttgctgttgttgggtggaatttcaattacgtcaagttggttgatcattttgttgaaatcttgtataagcttacttattttatgtctgtttattctatcaataactaagagagagtgttgaaatatttcagtataggccgggcgcggtggctcacacttgtaatcccagcactttgggaggctaaggtgcacagatcacctgaggtcagcctggccaacatggtgaaacccgtctctactaaaaatacataaattagccgggcatggtggcaggcgctggtagtcccagctactagggaggctgaggcaggaaaatcgcttgaacccggcaggcggaggttgcagtgagctgagattgggtcatttcactccagcctgggcaacaaaagcaaaaaaattaaaaaataaaacaataaaaaataaaactgtctcaaaaaaacaaaaacaaaattgaaatatttcagtataattgtggaattatctatttctcctttcaattctaccagttttcctttatgcattttaaagctctgttattatgtgcaaaaacatttaagattactatatttttttgatgacttgagccctttatcaatgtgaaatgactctgtttatctctgataacattccatggtatgaaatcaacttcgatatttatgtagtacttcagctttcttttgattacttttatcatggcgtatccttttccatcttttataaccttttattattttcatatttaaagtgcatttattgtaaggagcctatacttgggtctttcttctgttcaattctgatttatgtcatttaatgactggtagtccatttacttttaatgtgattattaatatggttacgtttaacctaccattttactgtttgttttctatgtattgcattccccattttgccttcttatggatttgttgaatattttctacaatttcatttatctgtttgttggtttgttagctatacctctctttttttaatgactgatttagggtttatagtatatatcaggggatggcaaactatagcccctaagccaaatctgcttgccacctgttattgtaaataaagttttattgaaatacacccacgctcattagtgtatttattgcctgtggctgcttttgcagaacaacaacagtattgagggtgggtgcagcagctcacgtctgtaatcccagcactttgggaggctgaggtgggaggatcacagaaggagttcaagaccagcctgggccacacagggagaccccatctctaccaaaaaaaaaaaaaaaattagctgggtgtagtggcatgcacctgtagcctcggctacttgggaggctgagatgggaggacagcctgagctcaggagtttaaggctgcagcagctgtgaattcgccactgcactacagcctgaataacagagtgaagccctgtctcaaaaaaaaaaaaaaaaaagtaaaaataacaataaaatagaacacgaaaacagtagaattgagtagttgtgacagagaccataaggcctgcaaagatggaaatacttactatctgaccctttacagaaaatgtttgccaacccctgataagcactttaacttatcataatctaccatcaagaaatgtcatgctgtttcacatatacttgcaacaataaattcaaatcctggattggcctttgtgctcttgtcaaaaattttacttctatttataaggcccacaatgcattgtggttatttttgctttataaaattatgtttcaaagagatttttttaaatacgaaaaaagagtcttttatattaacctcccctgctccctcccaaccccctacacaatgaccatttctggtgttctttattcctttgtataaaaccagatttctacctggcattatactttggcctaagggacttctcttaacatttcttatagtgtaggtctactggtgattaattcttttggttttgtatgtctgaaaaagtctttattttgattttgcttttgaagacattgttactggatataaaaatctaagttgacagtgttttttgttttgttttgtcttttagcactataaggttgctttgccactatcttctggtttatattatttctaacaagaagtttgctctcattcttatctttattcctccatacctgtatcttcttcctggttgcttttttttttttttcctttttagtagtagatttaacaacttgattttgatatgtttttatcatagtcttctttacatgtcttgtgttgggatttgttaaatttcttaaacctgtggattaatagtttgcattaaatttggaaatgttttggctattctttcttcaaatattttttatgatcctctgcttcctcttcccaccagactcccgttacacaattacacatatattagactaactgaagttgtcccatagttcacttatattttattctttttttcagtctttttttctctctgtgtgttttagtttggacagtttgtactgctatatattcacatttactaatcttcagcactttctaatctgttattaattttatccgatatattttttattttggacatttagttttatttctaaaagttttaattgggtctctaaaaatatttctcatgtctctttttaacatgggcatacttttgtctaccatcttaaactttcaggatataggtatagttactatcttaaagtcctcctccacttattctattgtctcatttctgggtctgtttatgttaatttttctgccaattaattttcatccatttccccaatataactcttttttcttgagcatttttttctttctttttttttttttttccctgttgcccaggctggagtgcaatagcatgatcacggctcactgcagcctcaacgtcccgggctcaggcaattctcccacctcagcctctcaagtagctgggactacaggcacacatcaccatgcccagctaattcttaaattttttgtagaatgaggtcttgctatgttgtcagggctggtctcaaactcctgggctcaactgatcctcccaccacagcctcccaaagtgctgggattgtaggtgtgagcgaccatgctgagccttcttgaatattttgaaagaaatctccgacaacatgtgtctcgtaaatatttcagtgtgcatgtctaagtgataattagtaaagatttttttttcacattggatggataatgtggtgttgatgtagtaacaaggtttgagggaggctgatctcacactttaacatgaaaacgaaatcatcacacttatgaaccaaaaaagaatggtaaagactttaaaaaacatcatccctttgctatttatcacttaagaaaactaataaccattcctgaatataatctaacattcagatcgtatgtgaattgctctacttcatcttaaaaatgcctttttacagatgatttgtttgactcaggatacaatgagaatcacaaattggctgctatatctctaagtctcttttattctataagtctcttttcaatatgctatagcatgttaaagaaaatgggtcgtttgtctgcagatcccacaatccacattggctgattgtttccttgtggtatcatttgacttgtgctgcaaacccttgtatcccctggaaattgatagttgggcctagaggtctaagtggtaggctcaggctgaattttacaggcaagaaccctccatatgaatgctgcgcaattttgtggcatcacatcatgtggtacattatggcgcattgtcccatttttagaaaggccgagattgatcagtatgtgctggatgtgccccactgatgcctccactgggaactcctacaacatctcatctcatgtttttggcttgcatcagggaagaaaaactttattttatttttatttttatttattctatttattcatttatttttttgagatggagttttgctcttattgcccaggctggagtgcaatagggcaatctcggctcaccacaacttctgcctcccgggttcaaactattctcctgcctcagcttcccaagtagctgggattacaggtgcacgccaccacagccggctaatttttgtatttttagtagagacagggtttctccatgttgatcaggctggtctcgaactcctgacctcaggtgatctgcccgtctcggcctcccaaagtgctagtattacaggcttgagccactgcgcctggccaaagaaaaatgttatactcagattatgaagataggcagggccagtatttttaggcacacatctgcttaagaggtggctatgggaacactcttggctcacgcttaggcagcatccctgtctccatggcttctctggtcattcacccatttgcctgcctgttgggctgtgcacttgtcagagagggccagtggcctgctacggtatccgtaacattattccattgtaagtcctcaccagaggttttgtgggaagccacatgagaaactagaattttcatactagaaattaaagacagttgggggggagggtctgataaaatagccttgaaaaagactctttggcatgaaatagttactctatttttttgagggttaaatgtcctttctttgatgaagtcatgttaatgtagttcgtaaatggccaaatataaagttggccattttattttactgatctgtgaaataaaaaagtttcagataacaggttaagataatcctcaatctaggaagtatatgagaatctccgggtagcatgcacttttaatatttttccaagaggacatagcttaggaaagaaaaaagattgggaaacgctgctctaaaagacaatggaattagcatgatgaacatcaatctatcagatgataaaggtaactataactggcaacgtcttttttttttttttttttttttgagatggagtctcctggaatgcagtggcgtgatctcagctcactgcaagctccgcctcccgggttcacaccattctcctgcctcagcctcccgagtagctgggactacaggcgcccgccaccatgcccggctaattttttgtatttttagtagagacagtgtttcactgtgttagccaggatggtctcgatctcctgacctcgtgatccacccgcctcggcctcccaaagtgctgggattacaggcgtgagccaccgcgcccggcctttttttttttttttttttttaaatccataaaggtccactaccagccagatgtggtggctcacgcctgtaaccccagcactttgggaggccgaggtgggtggatcacgaggtcaagagatggagaccatcctgactaacacggtgaaaccccgtctctactaaaaatacaaaaaattagccgggcgtggtggcgggtgcctgtagtcccagctactcgggaggctgaggaaggagaatggcgcgaacccgggaggcggagcttgcagtgagatgacatcacgccactgcagtccagcctggcgacagagcgagattccatctcaaaaaaaaaaaaaaaaaaaaggttcactatcactcaataccacattaaaaataaatagccacaatgaagtaccacttaacacccacgaggatagctatgatgaaaaagagataatagtaacaagtgttggtgagggtggaaaaagtgaaaccttcacaggctgtgggtggggacataaaatggtgcaagcaccacggaaaacagtctggcagttccttaaagggagatacagagtctccatgtgaccaagcaattccatgcttagttctatacttaagagaacttcaagcctatgttcacacaaaacctgcacacaaatgttcatagcagcgttaaccacaatagctaaaaagctttaacagcccaaatgtccaggaactgaagaatgggtaaataaaatgtggtctatccatacaatggaatgttattcagcaataaaaagaaatgcagtgttgattcatgctacaacgtggataaaccttgaaaacatgatgctcagtgaaagcagccagtcacaaaggactacatattgtataatttcatttataggaaatgtccagagtaatcaaatccagggccgggcacggtggctcacgcctgtaatcccagcactttgggaggctgaggcaagcggatcacgaggtcaggagttcaagaccagcctggccaacatggtgaaaccccatctctactaaaagtacaaaaaattagccaggagtggtggcacacgcctgtagtcccagctacttgggaggctggggcaggagaattgcttgaatccggcaggcggaggttgcagtgagccgagattatgccactgcactccagcctgggggacagagagagactccatctcaaaaaataataacaataataataataaaatcaaattcagtgacacaaagtagattgtgtttcctagagcgtgagaggcaaggaaggagggagatgggaatgactgccagtgggtatggagtttctttggggatgagaaaacgttctaaaatgttctcagatgatttcaggatggtcgtacaactctaccaaggtaactggcatgaataaatccactaaaaagataaagttagattagaatgaatgtaatttgttaatacacacacacacacacacacacacatatatatatatatatatttttttgagacggagtctcgctctgtcgcccaggctggagtgcagtggcgcgaacttggctcactgcaagctctgccttccgggttcacgccattgtcctgcctcagcctcccaagtagctgggactacaggtgcccgccaccatgcccagctaatttttttgtatttttagtagagacgtggtttcaccgtgatctcgatctcctgacctcgtgatccgcctgcctcggcctcccaaagtgctgggattacaggcgtgagccactgagcctggccaaatctgtgcatatattaaatccactaaattatacagtttaaatgtatgcattgtatggtatgtaaaatacatcttaataaagctgttataaaataaaaagcagccttttgaataaatatcgccttaaagacctgaaatgtttcactcatctgccatgtagcatctcaagattagagatttacaaagttagaattgatttcgcagtcatctggtctttatctccttattggctttttcatcctctttctccatttttaaaattttaatttaaattaacaagactacccatttattaagtaacaatgaaagacaactctaccaatgtaactggtatgaataaatccactagaaagataaagttagattagaatgaatctaatttgttaattcatttgtttaatgaataaagatttggaataaatggtgttgcataaacccatttcctgaattaagaatagggaatataaaatatcctaaagcctatagagaacagtgagctatcattttaattttatgacagttttaaaacagagacggatgagaatgagagctgttgggcctgtggacataaagagacaggcagacagaaggaaagctaatgttgttagaattggtggctccggtataaatcggacaggaaaacactccttaagatagaatccttcagagtggaaggaacatgaaactgtgaaaagcatctctctggaattcctagtcagagataatatatgaagaaagcagactgtctactaaagaactagtgactgatagcatatgaccacaagtgttttaaactacggacagtgagagtttgaaacgcagaatatcaaatactatgtcgtgaattcaaaatgcagaaggattgcattagtaaaagtattcctgaggtcattattgaaaattccagaaggttcagagggaaaaataaataggcagaaatttctacggaggccctttctgattcaggcagagctggtagacatgtgactcttgcctgtcatccagggaggccaggaccataagattcaaagccactctagagcaggggtccccaaccgccgggccacaccgaagcttcctctgtatttacagctgctcccatcactcgcatgaccgcctgagttccacctcctcagatcagcagcagcattagattctcaaggaagcgagaaccttttgtgaactgcgcatgtgagggatctgggttgtgtgctctttaatgagaatctaatgcctgatgatctgtcaccgtctcccatcacccccacatgggaccgtctagttgcaggaaaacaagctcaggattcccactgattctacattatggtgagtgtataattatttcattatgtattataatagaaataaagtacacaataaatgtaatgtacttgaatcatcccgaaaccatccccccaacccccaaccccattcatggagaaattgtcttccacgaaaccagtgcctggtgccaaaaaagttggcgaccactgctctagagagaggatagaagacacccaaatcagccaagagcaacaacaacaacagaggaggatggctttcaaccaagtttgttttttgtttgtttgttttgacagagtttcactctgttgcccaggctggagtgcaatggtgccatctcggctcactgcaacctccacctcctgggttcaagcaattctcctgccttagccccctgagtagctgagactacaggtgtgcaccaccacacctggctaattttcgtatttttagtagagacagagttttaccatgttggccaggctggtcttgaactcctggactcaagtgatccgcccgcctcagcctcccaaagtgctgggattacaggcatgaaccactgtgcccggccctttaaccaatcttgatggtttatcacatagagagctcatgctctattgacctgtaaccatgaggcaaaatttgcccagaaaatggaggttcctgaaagatggttggacctccaggtatttcaagaaacaatttcaaccgctgcagcttccaacagagacacacaaaaaacaaacaaacagaatgatagagaaagaccttcctgaggcaatattctcagtctgtgaccttttaagatcctgctcaaaagattttaaagccaggttgtgctttgataagtaaaggcatatagttcctttgtacttgttctaaaggattaaatgaagttaaatttaatgcctccaaatccctaaggccttattatggactccatgaattaatttttcaaatcgctgtttgtttggagagcctgtcctgtgtctcctgcaagctggtcaaagaacattttgtactggctctgaaagagctccgtcaagtcacgggagactccatttcaatttaacacgtggcaattaattctcgcaaaagactgtgcctgacagcttcaacagtgttgtgtaagaagacagagtacaatttggtggcgtatcaatttacagtgttagcatatttttacatgagccataaatcttgcagattcaccaactctcagcttaatttataagctttcgtttctgggagcacgtcccactgcagtctcgcctccttagtgttgtaacagctttcttgagatttcacttcagaatttgacaaggtgtccaagatgaatggtaatcatgttacagagctagagaaacatgcgaaccagactatttataactctgcccttttactagtcacgttcagtactatgtggccttaacctacagttattgatctaaatgacctagttctgaactgagacttttccatttttagagttaaattataatttgtagtaatcctttaatactttaaaaccctcaaattgttaatagttgtattgagatgtaattcacacatcatacaatcacttattgaaagcgtacaattcgactgagcgaggtgcctcaggcctataagccccacccattgggaggccaaggtgggaagactgcttaaggccaggagtttgggaccagcctggggaacatagcaagactctgtctatataaaataaataaataaatacataacataaaataaaatcaaaaattaatcaggtgggtggcacatgcctgtagtcccagctactcaggaggctgaggtgggaggatggcttgagcccaggaggttgaagctgcagtgagctatgatcacgccactgcactccagcctgggttacagagcaataccttgtctctaaaaaaattaaatgaaaataaataagtaaaaataaagtgtacagttcgatttttttttcatatattcaccagattgtgaaccagcaatcattttctatctgtatagatttacctgttctggacatttcatagaagtggatcacacaatatgtagttttttgtgactggcttatttcacctatcatgatgttttcaaggttcctctatactgtagcctgtgtcagtacttcatttcttttcattgacaaataatattccattgaatgcatatatcacaatttgcttatccattcatcagctgacagacaacacaaaaatgttctacaagaaaaaatagtggctcatatataatcatgaaatatcttggctgtctgttacatatgcgctgcaataatgtttaaacccttgctaaagtataatttgcctgaaagtctgggtatgaattatgatacagaacatgaattatagattgtgcagtgttttattcagggttttctggattagtagagacttttctctgacattcgcatatatcacacttccaacagactcctggttctaacacagcatgttcttaaaagcctgtcagtgatgctttagctatgtcggtgcaatatttatcctgtgatgtttcaacaagggatgtctaaaatagccaggaacttccagatcatcaaaaacacaatccactctctagattccaggctttgcaatgactgcccagctccaaccacggtgaggaggtatttgcaaggagtctcaggctgcagagagatgaagggtctaaaaggagtccttccagaagtgatgactcactgcctttaaaggacatctgggactcagctgcaaacataacctcaatcaatttttgcagagatgtatagcttatttgccgataatcattttcatgagagatgctatttcattgcctgaagattaaaatttataacactggctgtagcagcaatagaagccgttgaatcgccaccattataacccgcaggtgaacagcaccaactgttgtgtgaaaggaatggcagcctcaaagcagttacaggctgattggaataagggaaggatttagaataaaatgttgtagcgagccaggtgtggtggttcacacctgtaaccccagcaatttgggaggctggggtgggtggattgcctgaggtcaggagttcaagaccagcctggccaacatagtgaaaccccttctctactaaatatacaaaaaaattagctgggtgtggtagtgggtgcctgtaatcccagctactaaggaggctgaggcaggagaattgcttgtactcagaaggcggaggttgcagtgaaccgagatcacaccattgcactccagcctgggcaacaagatcgaaactccatctcaaaaaacaaaacaaaaacaaaaacaaaacattgtagcataaaatatagaggcaagtggggcgtgggtggagggaaccggcggctgtcagacacaggcaatgaatggcctagaaacccaagtgccgtgtgttcatgcttgttctgctaattcaacaccaagatatcatgtctatttactccactgtgaatgcagatggttgtattgattgtcagaatggtgaactgaaataatgtatgaaaaagtgcctaaaacatgataggtgttctgtaaattattcagtgaacccgacaagagctaaatgattccaatgctgcttatgtcaaataccaatatagaaatctctattttgcaaaataatttcccaatcccaattattgcaataactttcaaacaatttttacacaacacaatcatttagagagacccacggatttcactattgttttgtgtagaacaggacattcaacttaatctggtactagggatatatagtacagtacagacacaattcctgttctctacaagttgataatctcatggagaaggttacacttacccctaccacctgtgagatctggataaatatttttttgcatgtcccttgtctatataactgaatttttacaacgtatttcaaagttcatacacccatatgagatatggtgatttattgatgaagattttgaaaagtggcaagaaaatagagattaaagtatttttctgttgtccaaccagtgcatgtaaaaattctttttagtgtccaagcactattgctttttgttgaggttcaggaatcatctctttatgttctttatcatcagatgccctctaactgcttccacatgccccttcatgagaaaaagttagcagggctgttactcaaatgctgtggctcttcagaaactgagtggaccgaaaggttatggatcgtcttgtctctgcggttctctaataccactcatctgattacatcattactcatcgcccactgggcttccagtgactccctccaaggttgttactgggcttcattaatgatgaccacaaatgcaagtcttacccagaatatgtagaagaatttgaacaatgatttgttttataatcagtttcactcttctgtttggaatattaccacttaaacctggaagaacacatcatccaaatatgtactccttagactataaccccagcattgctagaatgtgatctctttgatactatctgtaactcgactttccagacaccaccaccagcagggaggacaggtgaggggtcctgtgtggagagagaagagtggttccattcctgcaagaatatcagtcttttatctggcagaacaggcagctcagtgatgggaagcaagggatggtattaattggaagggtctgttggattggaagggcccattggcattggcatggtagagcaatagtctcaaaagctcctccatggaggagacagtcagggcgcctctcgaggacttcctgacacgtgcaggagtctatggaggaggtggagtgactgccctggtgacagcagttgagggtgcacagggtaaaagacccctgccaccacccccagtggccctcaggggctattgatgggaggtggccccacagttgggaaatgtgagcaaaagcctgggctggcttcatgagtgtgtgactttgggttcatgtaaatggagtcacattatatgtggtcttttgtgactggcttcttttccttggcataatgtttggtttaatgctctattgtcatcatcttaaaatttttaattcaattcaattaattaatttttttttgttttgagacagagtttcactctgtcacccaggctggagtgcagtggtgccatcttagctcactgcaacctcaccctcccaggttcaagcaattctcctgcctcagcctcccaagtagctgggactacaggcgcacgcaccacgcccggctaatttttgtatttttttagtagagacggggtttcaccatgttggccaagctggccttgaatgcttgacctcaagtgatcgcctgcctcggcctcccaaagtgctgggattataggtgcgagccactgcacccagccaaaatgtttaattttatctttgcacatgtgttttggaaggaaagtctaccggggcaatggaacttgcgtgttcgcagtggagatatgccaagtgtccagacactgagcaatggccgggcagccagggacactgtggagtccttaggtagccaggtcaggacctgggccttaatcagtggtgacaacaggggctgtagcagcagtggtggtggtggcagtggtggcagccatgagaaaaaggagaggcttctcatgggggcagcaacacgaccaggaggtggggagcagcttgcctttctgtctccggagcccatccctgcagcatccgcacaaatgctaactctggcctgagccctgggacaggaactgcaggtgatcgggcagtcaactttgtcagtaaattattattattatttatttttatttttatttttttgagacggagtctcgctctgtcgcccaggctggagtgcagtggcgcgatctcggctcactgcaagctccgcctcccgggttcacgccattctcctgcctcagcctcccgaatagctgggactacaggcgcccgccaccacgcctggctaattttttgtatttttcatagacacggggtttcaacatgttagccaggatggccagtaaattattacaaaagaaaataatacatatgggcattgcaatacagcataccaggaagctattagaattttcagagtgtggactctatagttttttaaaatactggaacactacaaagcaaacatccacaggcttagaaattaaatttaaaagtcattggattcaattattttcataagaagcttcaaatgaaccaatgattaatgagaaagacaattttaaaattaaattttccatgtaaaaatacaattacagaatgcataaacaagtgtttaaattatatgaaaattatgaatacaatttcaaatgacctctacaagttagaggaaatgtcagagaaaaaccttaaaatgccagtgtgtaaatttacatttgtttgctttgtgtttttgagatgggatcttgctgtgacgcccagactggagtgtagtggcacagtcatggatcattgcagcctctacctcctaggctcaagtgatccatctgcctcagcctcccaagtatctgggaccacaggagtgcatcaccacgctcagctaattttttaaatctattatagagatggggtctccctgtgttgcccaggctggtcttgaactcctggcctaaagtaatcttcctgcctcagcctcccaaagcactgggattacagacgtgagccaacgtgcctagtcaaaattaatttttttttttttttttttttttttttgagacagagtcttgctctgtcgccaggctggagtgcagtggcgtgatctcggctcactgcaacctccgcctcccgggttcaagtgattctcctgcctcagcctcctgagtagctgggactacaggcacctgccaccacaccctgctaatttttgtatttttagtagagacagggtttcaccatgttagccaggatggtatctatctcttgaccttgtgatccacctgccttggcctccaaaaatgctgggattacaggcgtgagccaccgagtctagcccctacatttacatttaaaatcacattcagatttaaacaaaactgatttgtatgaagaggttaatcttttttagaaaaatcattctgtgaaaatcatctctagatgtgctaaaatgtggatttcaaaataatttgccagaaatttttcccaaagctgtcacagctcataaatattcttagccccagaaagttttgtccttctcaaaataaaagttaaagtattactcaaaaattagccaagcatggtggtacatgcctataatcccagctacttgggaggctgaggcaggagaacagcttgaacacaggagatggaggttgcagtgagctgagatcacaccactgcactctagcctgggagacagagcgagaccttgtctcaaaaaaagaaacaaaagttaaagtattattatttatcatattattaatacataaagttatgacagacaatggaatattattcaggattaaaaagaaatgagctatcaaggcatgaaatgatgtggaggaagcttaaatccatgttaccaagtgaaaaaaaggcaatctgaagagacacatacatactgtaaacctaaaactgctctaaaaaattagcctaattaaaagggggcaaaaataagcaaaagacctaaacagacacatgacaaaaaaaaaaaaaaagatacacagatggcaaaataagcatatcaaaggatgatcaacatcgtatgtcactggagaactgcaaattaaaacaacgagatgccactacacacctggagtgtgaggcaaaaatctaaaacactgacaataccaaatgctgacaaggatgtggagcaacaggaactctcattcattgctggtgggaatgcaaaatggtacagccacgttggaagacagtttggcagtttcttgcaaaatgaaacacacttttaccatatgattcagcaatcatgctccttggtatttacctaaatgagttgaagcttatgtccacacaaaaatctacacatagaggccaggcacggtggctcatgcctgtaatcccagcactctgggaggctgaggtgggtggatcacctgaggtcaggagttcaagaccagcctggccaacatagtgaaaccctgtctcttctactaaaaatacaaaaattagcctggcatggtgacgggagcctgtaatcccagttactcaggaggctgaggcatgagaattgcttgaaccagggaggcggaggttgcagtgagtggagatcacagcactgcactccagccagggcgacagagcaagactccatcacacacaaaaaataaaatctacacatagatgtttataacaactttattcataactgcccaagctggaaagcaaccaaaatgtcctttagtaggtgagtggataaataaactgtagcacacccataccatggaatatcaggttttcacaaaggtgaaattttctgtatgtagattttagatcaataaatctaatttttaaaaagtctatatttccaaaaacataacaagtaaaaagttttaaagaagaaaataataaatcataactgcaaacatttcatattttacttcagaaaggtataataactaagaccatcctggaaaaaactataaagaaaatttttgtttttttttaagacctgatgcatgaaatcattttgaattctttttaaggatttgaagctgtattgttgtattcccacaaagagcatcctaaaactcccaaatgtttgaaaataaataaattttaatgactgtaatccaaaaacatatgatattttaggaaggatgttgattcttgcacatttgtatggcctctaagatcaaatggagaaagtagagggttgtgacaagacccccagagtgagtgcctaaactgcagtctcagagtgagtttacaccagaatgagcatgactgagaaatggcagagcaggccacacttcccacctatttttataagagactcaggtgactcatggcccagtgaccaaagcctgtgagagtctttgagactaggggatctagtactaagatccctaagctcgctactgatgagggtcattccttctaacagggactggtgtagatgcaaaaggagcccaaacagaggaggaagagatttgtgcataagcttaggcaagatccaaggtgccaggttaaagatgaatgggtctgagaacagattagtttctgttcagcttccttcagatgtcttggagtcttaggaaaatgaggctgtaatcactaccaccactgccttcatttacagtgtgtgcttaatatgggcttggcattgcgctaagcttttatgtgttttatctcatttcattctcataacaatcataaaatgcagtaattttccttatctcccctgtacaaataaaaaagtggagacacagagagattaaataggctgccagaagagggatgcccagtcattaaattgtagaaaaggaattcaaacataggcattctgactccaaaatatttacttgtaacaagtacaaaaaggagttagttacataaggatttgcatttttatacaaaaatttctacacaaaactgccagtaaaggcaagacagctttagaacctcaccagagtaaaacactagaggtggagagagaggagatggtatagtctggggaagatgtattccagcagtgctagtgagagaggataaagaatgccttcataaaacacccatgtgaaaatacactccacagccttcctgaacccagaaatgtccaacagtacaatgatacatacagcaaatcaggggctactgttctgattctgacactgactccactgtgccctacaattagtgtgacccagggaaacacatattatatatgtggttttcaaatttgcctgcatgttggaaatacctgggagactttaaaaatactaacatttgggtctcgcccccagaggttctgatttaattggttctggaaatttaagtttagtttaaggcttccaagtgactctaatgtgccatcagggttgaaaaccgctgtattagagggcattacagcttacttgatgagtactgggaaagactgctttagccaatctgccaaactctgagttttagttgaagggcttaatgcatttacatttagtgtaattattgataaagtaattatatttatatctacaatttgctatttgttttctatgtctttttgttgttctatgcctccattattgctttcttctgtgttagagattttctagtgtatcattttactgatttctttcctgtatttttttagttattttcttacttgttaccctgaggattgcaatgaacatcttagtttataaaaatctagtttgaattatatcagcttaattgaaattatatacaaaactgttgctctgtataactccattcactcctcttttttgtgctatcattgtcgtacaggtaacgtcttatataggttatatccatcaacataaatttacaattattgtcacgtgcagttgtcttttaaatcatataggaccggctgggcgtggtggctcatacctgtaattgcagcactttgggaggctgaggccagtggatcacttgaggtcagtagttagaggccagcctggtcaacatggcgaaaccctgtcacttctaaaaatacaaaaaaaatagctgggtgtgatggtgtgcacctgtaatcctagccactcaggaggctgaagcaggagaatccattgaacccagaggcagaggtggcagtgagccgagattgcagtgagcccagttcacaccactgcactccagcctcctgggcaacagagcaagactctgtctcaaaaaaataaataaataaataaaagaaaaaaaaggaagaaaggtgaaacaaaaaatcatatagaaaagagttacatgtgaaaacataattatactgttatttacatttacctgtgtagtcacctctactggtgcacctttcttcttcatatagatttgaattactgtctagggtgctttaatctaagcctgaagaactccctttagtatttccagtagggtagattgctagcaatgcattctctctgtttctaaaatctgggaatattttatttctccttcatttttgaaggacagttttgctgaattcctggcttctgaaggagttttgttagatataaaattcttagatgagtctttttctttcagtgctttgaatataacatcctactctctctactatccatagattttgatgataaatcagctcttaattttattgagaaattcttggatgtcataagttgcttctttcttatttttaagattctctatctttagttttgatgtttatcatgtgtctaagtgtgcatccctttgagtttattctacttagggttcattaagcttcttaaatacatacataaataaatgtttttcaccagatttgggaagttttcagccatatgtcttcaaataattattactcccctttctctctctccttaccttctgggattcctattatgtatatgttggtatgcttgatggtgttctacatatcactgaagttcttttcatttttcttcattcttttttctgtttcttagactggataatctcaactaaccaatcttcagtttggtgattcttccttctgtctcaaatttgctgttgaaacaatctaatggctttttcattttagttattgtaaattttacctccagaatttctatttgcttcttttaaaaaagtaatttatatctattgatattctctatttagtgagacatcactcttatactttcctttagttctttagacatagtttcctttagtttttgaaggcatattttaaatagctgacttaaagtgtttttagtaatttaaacatctgggcttactgtgggacagtttcattgattgcttccttcctgcacatgggtcataatttcttgtttcttggcatgtgctatggtttgaatgtgtcccccaaaatttatgtgttggaaacttaatctcccatgcaacagtgttgagaggtgggaactttaagaagtgattaggtcatatgactttgccctcatgaatggattaacatcattgtaacaggaatgggtcagttattatgaaagtgggtttgttataaaagtgagtttggccccctcttgctctcttattctcactctctcttgcccttctgccttccaccacaggatgacacagtataaagtcccttaccagatgctagcaccatgctcttggacctcccagcctctaaaaccattagccaaatacatttctgttcattattagtcacctagtctcaaatattctgttatagcagcaaacaatgacaacatggactaagatagcatgtctcacaatgtttgttgaaaactacatttcaaataatacagtatggcaattctcaaaatcagattctccccattccccagagtttgctattactgcttttgtgtgtatttttgtttgttcagtgacttctctgaatgaattctttgtgttctttgttgtgtgtagccactgaaattcctgcttagtagtcagcttagtagtcagctaatgattacagagagatttccttaaacacctggaaccaataagcctcttggtctttgccagtgggccatctgtgtacattgggcacacctttaggactcagccaggcagctgacaactctatcttagctttcacttcctcactgtgcagaggttcaaggtcagcagaggtcagagctcagggccttctcaggtctttcttgagcatgcagacaatgctgggcatgcacacagcccaatgtggccttgtagattcccaggaatatgcaggagcttttcaaagccccatggacatcccactctccagcttttccttttaaattttttggctagtctattatttgccccaactgttatccactgctttgggaggctgcaaagttaaacaatgtcttttaagtgtttttgacaaatgtccccaaggaaaggctttggtaccaggtgagctcagagtcaggtcaaacaaagacagtcttgttagtagggtctctcagggaactacgcaacaggtgaaataatgacaattctcaaggaataaggccttgaagaaccctagcccattttgccccctctggtggctgccaagctgctggttttcactgtgattgggaggctgttttcaaggctaacataaagtcagagaaaagggaatggagatggggcgagtgaaaatgccataaagctagttgttcttaccaagattcagccatttttcttgagtaaattctccctggattgtgacaagactttaattttcagagttctgagaaaagttgattctgaccatttttgccattttctcattgctttctatggaagaaagaattttcagaggtcctcacttcgctatttttgctgacatcaactcccagtaaggtggctgggtatggtagctcatgactataatcccaaccccttgggaggctgaggcgggtggatcacttgaggtcaggaattcaagatcagcctggccaacatggtgaaaccctgcctctactaaaatacaaaagattagctgggcatggtggttcgtgcctatagtgctagctactttggaggctgaggcaggagaatcacttgaacctgggaggcagagattgcagtgagctaagattgcaccactgcactccagcctgggcaacagagtgcgactctgtctcaaaaatcaaaaactcccaacaaggaactactggtctagtgaatgaatatcatcatattcacacctatgcttcatgttcatttcaattgttttaacactttgtattaagacagctctgtttctctggaggtcctgctgagacttctagctgtgtgccactggcaatgaaacccaacatatttaccatacacacttgtgagcacattcttcagatatccctctgaattataattgtagctgttgtaagtcattttgggacagtctgccctcgaggaaccaaaacaaataaatagaaaagattatctctcaatagctttaattaattttgttccattagtcttgcactttcatactgctatcacataattatttgtaaattatattcataactgtttcttaatttgtagtaattttatcactcagaggataatagttaattattttccctataattatcatggaagaaaaacagggctctttaaaactgtgaaattaaattggaaaggaatttcaaacagccacacttccctttgccctgacatcccagatggtgtctatggtttgtgttcacagttatgcaaaatgacagatgtcaggaagcaaatattttcagcatattaataagagtgaatgcactgccaccttctgcattgcagccatgcactgacacagaatgctgataactctcagatggagcagacgaaaaggctcaggtacactcctggattgtttagtgtctggagcagtcaatggaaaatcaaaacactgaagatctagcacctactccaccagagactcactgtgtgactttggtcatgttccttttaggagacagggatatgaactagtaagtagagaagtaagactagtaagcagagagccacatctcattgattcagcatcatcatcagagatgagatggtgcacacaccataattctccaaatagctgaagcttattttaagctctgacatgttaatttttatcaattttgaaggaaatccctctaaaacatatcatacagtcatattgtttcttaaagtgaatgacataaaacataatttcaacctcctctttaaccaacacaaaaatatataataggcggggcgcggtggctcacgtctgtaatcctagcactttgggaggctgaggtgggtggatcacctgacgtcaggagttcaaaaccagcctggccaacacagcaaaaccccatttctactgaaaatacaaaaaattagctgggcatggtggcaacttggcaggctgaggcaggagaattgcttgaacccgggaggtggagattgcagtgagctgagatcatgccactgcactccagcctgggcgacaaagcaagactctgtctcaaaaaataacaataataataataataataataataataaaacagatgggacaaataggtaaatttactcccaaatttacatgacatggaaatggattatgtgtggcagttaaaagagatctgctgtagtcaaagaactctcttcccaacttgaccatttccaaaaaggcctgcatctgctggaggtgacatgtcactctacagaggcctctgggcctgacttctcttccagagggctgagacttagtatgtggatttgcaggcctagtagccagagtcgctgatccctccggcctcctctggaatgtgttcttggatgagttaggctttctcaacacgtgaacgcagtgtttcaggtctatcccctaatcttaagtactatgaccctcttaccttctaggtgaggggtgcccccctactctctgttcaaatcatgtttcaggtggaatggaaaggtgatgtgtctggttttcaaatccttgtgcgttggaagcattgatgatgacggcagcaacctcagctcattcattttagctccctctgctgtttcagcaacatagatcattaaaacaaaaaactaccacagaaaaccaaaccaacaacaacaaaacccctaagaactctatttttttttttctaagaactctcaaggagaggaaaaggaaagaaacttaattggggcttgaaagttttataaaagaagcaatctttatatgaaaaactaaagaggatatggaatacacttttctaaaatagctactttttctttcactgtgtctttttatcatcattaaaaattatgttcacattaataaatattaccaatctgataataataatttatggcttggagttattgatttattcttcaacaaatatttatgatcccattatgcacatagtacatggggctgggtgctgtggatacacaggggaggaagagagttgttttaataatgctctttagctgggcacagtggttcatgcctgtaatcccagcactttgggaggccgaggcaggcagatcactcaaagtcaggaccagtttggccaagatggcaaaaccccatctttactaaaaatacaaaaattagctgggtgtggtggcatgagcctgtaatctcagttacttgggcggttgaggcacaagaatcacttgaaaccgggaagcagaggtttcagtgagccgagattatgacactgcactccaccctgggcaacacagtgagaccctgcctcaaaaaaaaaatacaaaaagtagccaggcacagtggcgcatgcctgcaatcccagctacatgggaagctgaggcaggagaatcacttgaacccagaggtggagactgcagtgagccaagatcacttcactgcactccagcctgggtgacaaagagagaccctgtctcaaaaaattaaaaaaaaaaagatactctttaatctcataaatctgcatgggtttattcctgttttcattgtcataaccattccttggaaaatagatgaaatcattaatgaagattaatgtaatttactatagatttattttaaaaaataaaaccctttaaaagttttgtctctgatcttcaaacctatcattaaaggcagtagtatgaaccttgaaaacaaacttgggcacgtgacctaaaccttctgtgccttagtttccttagtataaatgggatgctggcgataacactacttcatataggattgttggaaataataaatgagttaaatcactttaagtgctcaggctaatacctgacacccagaaagcacgaaataaatgttagttattatctttattcatttgtgaattcactgagcacctactatgtttttcctattcatatgagcaaacatacaaagactttatgctttgctaattgtttccatcatttacagcaaaatttctaaaagacaagttttccataattgccgtctctgcttccctactgccggttctcacttaaatcctccatactctggatcctgactttggtccccttcagtacctgtattcctgaaaggccgttaaagatccccaaattccccgccgggcttggtggctcacgccggtaatcccagcactttgggaggcctaggtgggcagatcatgaggtcagatcaagaccatcctggccaacatggtgaaactctgtctctactaaaatacaaaaaattagctggcgtggtggtgcttgcctgtagtcctagctacttgggaggctgaggcagaggaatcccttgaacccaggaggtggagactgcagtgagccgagatcgcaccactgcactccagcctggcaacagagtgagactccatctcaaaaaaaagaaaaaaaaaaagatccccaaagtccagtaagacattcacgtggaccttcttcgtcttgaagtctggaaagcatctgctgcctgacatgtattgttcttgtggtttctctgacacagtggtggcagagttctttttttttttttttttgaaacagggtttcactcttgttgcccaggctggagtgcaatggcttgatctcagctcaccacaacctctgccttcgaggttcaagcgattcttctgcctcagccttccaagtagctgggactacaggcatgtgccaccatgccggctaattttgtatctttagtagagatggggtttctccatgtcggtcaggctggtctcgaactcccgacctcaggtgatccacctgcctcggcctcccaaactgctgggatgacgggtgtgagccgctgctcctagagttattttatctctgactctttttctgtttcctttgatctttcttttgtcccaatgaggcagggaacctaaggatttcctacaactaaatcaaacggaaacacttcagtaggataggaaatgtcctcttcatttacatagggcgtacaccgagtaaatgactttataactttacttcatccccttcatttgcaaagggcatacagtaagtaaccaatggaaacctctcgagggtatttaaaccccagaaaattctgtaacaggactcttgagcctctatgctccggcccgctcccacactgtagactgtacttttgttttcaataaatttctgcttttttttttttttgagacagggtctcactctgttgcccaggctggagtgcagtggtgtgatctcggctcactgcagcctccgcctcctgggttcaagtgattctcgtgcctcaacctccctagtagctgggactacagccgtgtgccacgatgtccaggtaagttttgtatttttagtaggcacggggtttcaccatgttgccagctgtaactcagggattcccaggatcccgtcttcagttttgacaatttggtagaacagctcacagaattcagggaaactctttacttatgtttactgctttattataaagggtacaactcagaaacagccagacagaagagatgcataggtcaaggtatggggtgggggtgcatggagcttccacgccctctggggcaggccaccatcccagcacctccatgagctcagcaacctggaagttcatcaactcttgttcaagggtcttcagagagctgttttccagtgagtggggatgaaagttacaaccttctaatcacttggtgtttctggttaccaatcccatcctaaggctatttaggggccccaccctaagtcacgtcattagcacaacttaaaggttctagaaagggactttttaacacagacaaaagccactcctatcgttcaggaaattccaagggttttaagagctttgttgcagaaatctgagacaaaggacatatatatataaaatatataaatatatacgtattattattatttttatttttttatttttttgagatggagtcttgctctgttgcccaggctggagtgcagaggcgtgatctcggctcactgcaagctccgcctcccaggttcaagcgattctcctgcctcagcctcctgagtagctgggattacaggcacccaccgccacgccagttcaatttttgtatttttagtagagacgaggtttcactatggtgctcaggctggtctcgaactcctgacctcatgatccacccacctcggcctcccaaagtgctgggattacaggcatgagccactgcacccagccaaatatatttcagagccaaagggcttaggtatgaactcaagcaccatgacttaggagctgtgtgacttgggtgccttaagtaatctccatgaatcacagtttcctcgtccgttaaatggcgataataataaaacctccctaataagcttgttgtgaggattaagcaagttaacagaagcacttaaaatagtacctggcacatagtaagcgattcgaaagtgtttgctcactattcactccgtggctcactccattgtaagataatattctaactcctttcttccctacaggttaagttcccaagggcttttaaggctctctattttacaaaatcttaaattccatattattcacagcaagtaatttaataagtattaaatagaggcaagattggctagaagtggtcttcattctaaatgaagaccttgggaagcggggtgtgtgtgtatgtgagtatgtgtgtgtgcatgtgtgtgtgagtgtgtgtatgagagtgcgtgagtgcatttgtattccagaactccactttctggaataggaatatttaggaagaacatatctaggctttcagtacacctattgaaatgggagagttcccttatctcccttgcagggcgtgtggctggcttcttccgtgccctgctgctcagacccctaggggagcatgcagatgggcaggtgcagaggtcgtggggagcgtttttgggctctgacccccaaggcagtgaagcccaagtgggcgtgtgttacagtgtgctccttcagctttgctgtctgctgatggcttgtgttaatcagctggatagaccctctgccttactgcaagggcagagggtgtcctgtatcctgagttcttacccagtgtactggaaaaattgtatcacacgtgagctcaaaggatgagtgcaaggttttattgagtggtggaagtggctttcagtgagatgggtggggagccgaaagggagatggagtgggaaggtggtcttcccctggagttaggacgcccagcgccccccagccaaactcccctcggtgtccacctagttctgccatccctggtctgccggtgtctgctggtgtgctcctctgctcctctccatgcctagccacttgtgtctgtgcctgctaaggtcttgggcttatatggacacaggctgggggcacgtgtcaggccagagaggtcttagaaaatgcaacatttgggcacaaaatcaaaacaggagcgcctgttctcacttagatctgtgggcacaagcccaagggtggagctctcgccagggaccctgcccttttctacccagcactttcctgcccccccgtcctgtatcactagcagtatagtaatatatacagataagtaccaaacccttgcttgaagaatgaaaatctttccaaatcagaaattaagaagtgatttttggcagagatattgaaataaattatgttcctggttgctggtggaatgtcagtatttccattataaattgtcgattcaaattcagatggtacaggatggagttcactgtgttccattaaagcctttgaattccagggcgtgtgcgccctgattcctttcaggttattacacagttttccttgaaacagggataaaattggctgattcattaaactcatcatgacataatgctaagtaataaattcaaagacaaacccatacaggaaaatcaggtcgcaaaaactaacaatctttcttacacatccacttgtttcatttgcagccatttttatgtatttcagtttaatttatgaggagttcagtttaatttgtgaggactcctagaatcttttgaaggatctgctaggaatttgttgctctgtgcaaacaaagatctatgcttcctttaagactcagctcaagtcacacctcccattaatcttacttaaccagaaatcttatgtaactcttcttatggactgtgtgttgtgttcccaaaaattcatatattaaaatcctagcccccagtgtgatggtgtttggaggtagggtctctgggaggtgatcaggttatgagggtgcagcccttatgaatggcattagtacccttatgaaagagaccccagagagctccctcgccctctttctgccaagtgaggatacaatgagaagttggcagcctgcaccccaacagacccctcataggaacccagccacgttggcaccttgatctcggacttccagcctccagaatggtgagaaatacttatttgttgcttacaagccacccagtctatggtactttggtatagcagcttgaactgactaaggcattccctggcctagtatttccactagttcatcatcataatcacctatgagtttttgaaaaaaaaaaaaaaaaaaaaaaaaaatcccaggccagatttctaaagattcccctaggtaaatctggaataggcccagtaacaattgtaaaagttcctgtggggattatgatgatcaggcagatttagaagctacttgtctatctcaatcttctagtacttaataggtgtgcagtagatgagtttagaaataccgaactcctgcagacctgcttttctgagaactatttctctatccacaagtagtgggtcctgacaagtttaactttggtacatgactttcttttggggacagtgatttgaccaagagaaggtatctgacataagctgagtcagacttttttcttgttttatttgaattgagagattgagcctgaaagagttgggaactgcgtcacttagaagagcatgagactcaaggtccacagtgccctgctgggcttctggggcttttctgcttcccgccttttctgccttttctggggcccgttgccatcaactcttcctggagttcccgtgaaacactggggctgctataaaaactaccgccacccctgagtgccttcaaacactagaactggattctctcacagtttaggaggccagaaatccaaaatcaaggtgttggctcacgcctgtcttcctagcactttgggaggctgaggcgggtggatcacctgaggtcaggagtttgagaccagcctggccaacatggcgaaaccccgtctctactaaaaatacaaaaattagctgggtgtggtggcgggcacctataatcccagctactcaggagactgaggcaggagaatcacttgaacctggagggcggaggttgcagtgagccgagatcacgccacttcactccagcctgggcgaaagagtgaaactctgtctcaaaaaaaaaaaaaaaaaaaaaaaaatcaaggtgtgggcaggattggttccttctgggggctgttgaggagaaactgccccaagtgtctcccctagcttccttctggtgttgccagcaatccttggcactccctggttgtaggcacatcactccaatctctgcggcctctcttttttttttaaggacaccagtcattgtatatagagctcaccctaaatccaggaagagttcatctcaagatcctcaactaattacatctgcaaagactctatttccaaataaggtcagaccctgaggttctgggtggactagatttcagagggacacttattccatcctctacatgcttatttgcttgagtgagctgccaaagacaacacactcaaaatcccaaagagagaggggatctctcttccccagcatttatatcagtcccataaggaactcaggaatcagcttgggtcatgtgaccacgcctggactgtgtcaagggaggcaggcattctgattggccagcctgagtcacacgctcatgtgcattggggaaagaggagtcaaatgattgacagcttcaccagagtcacatgggatggagaagggagttttcccaaagggaaggaatgctggctagatataattgcaacccctcagtatccccatgactcatctggtttcagatttgaaggaaaaataaaaattgcaattgacatttccatagttcataacatttatagcaaactggcccccaaacactccctctttccacagacttagcaagctttagttacagggttcctactacctagtaataaaagataaaaattctcagataaaggactgaaaccttagtctctccatctcaaaattgttacccataaaatcaactgactgtgttcaaagaagtgatagttgttcacattgacatagcactttgcacattcatatctattatcaaaattgatgagcacagtgactctgggagacaggcatgtgctattatctccatttcgaggggcggaacaagaaagacatttgccggaggtcacatgatcagcttgtgcagaaccagcctcagaatccagacccgcctgattcctgaacagcctctgcacttattataatggcccagttctgggatcccttcaaagccaggagagtactctgcagaacactttgtcctcctctcaaacagcctctccatgacacacggttgctcttttgctgggagacgccaagacaaacttttgatctcacaaacacgtttttcttcctcagaaacacatagtctcattccaaagaaatgcaaagctcagaggtttgtggaagaatcaatctttgctctcttctagaaaatgaaaaaacagggagctttgatattgtcttctcctccttaaagtaaaacaacaggctgggtgcagtggctcatgcctgtaatcctagcactttgggaggccgaggcagggggatcacttgaggtcaggaatttgagaccagcctggccaacatagcgaaaccccatctctactaaaaaaaaaaatacaaaaattagctgggcgtggtagagcgcccgtaagcccagctactcaggaggctgaggaatgagaactgctttaacctgaaagacagaggttgcagtgagctgagatcacgccactgcactgcagcctggggatagagcgagactccgtcacacacacacacacacgcacacacacacacacacgtatggctcctttctcctctggaactttgaggactgaggcttagggtgatgggcttcagtcgtgacaggagggacttgtcaggacttgggaagatatctgtgtgtaggtgtgtccatgtacttagtgggcatgtgcatgtggtgtggcatggaataacgacgttaattttcccgcagggtgattagttcccaggcaataacaacagaaaccaaacagcatttcttcactatctgcagaattgcgggaatttccgccatctgcctcatcccaggcctcttgaacaattgaaaaggaacccaggaaaaagggtggagaagagggttaattttagctgtcaacttgggtaggtcatggcacccacatatttgatcaaacaccagcctaaaaacaaacaaacaaacaaacacaatcctttgcagcaacaaaggtgtttgattaagcacccctgttgtttgtttgtgtttgtttgtttttgagtcagagtctcactctgtcacccaggctgaagtgcaatggcacgatctcagctcactgcaacttcccctaactgggttcaagcgattcccctgcctcagcctccctagtagctgggactacaggcgcccgccaccacacccagctaatttttgtattttcagtagagacggggtttcaccatgttggccaggctggtctcaaactcctggcctcaagtgatctgccctcgttggcctcacaaagtgctataattacaggcatgagccccacactcagcctcaaacatctttgttgctgcaaaggtttgtttttttattttatttccttttttgttttttgagacagggtctcactctgtcacccaagctgaggtgtggtggtgcagacatggttcactgcaacctctgcctcctgggcttaagtgatcctcccaccacggcctcccaagtagctgggactacaggtgagcatcaccgtgcccggctagtttttgtattttttgtagagggggtttcctcatgtttcccaggctgtgcaaaggtattttaaagatgaaatgaacatttaagtcactagactttgagtaaagtagatggtcctctgtaatgtgggtgggcctcacacaagcagttgaaggctttatgagaaaactggctgaggttcccctgaagaaggaggaattctgccagcagactgtcttgggatttgatctgcagcatcagtgctttcctgggtctccagcctgccagcctaccctgcggactgtgggctcaccaacagcactgtgtgagcctccaacaggactgtgtgagccaattccctggcacaaatctctgaatataaatctctacacgtcctgtcggctctgttccctccagcgcatccttgcacacatgcttctggctgccccgtgacgccggctttcccccttcactggtcgcatggcggctttgcttccctgtcccccaccccgggtgcatgggctctgctgtatcttgtctcttcccatgtaggccggtcctaccaagtacaggggtcgttttcacacatgctgtcattgtctcatatctctccgtcccctgctcagacacactctgccccttgagctgtccttgagctgatgactaccaagcatcgccgacttgcactcagctctcagggacgtcagcatcacagctccttctggtttcctaactcctctttgaaagacatttctaggggaagccatcgtttctaattaccttcagaggttatcaccaaaacctcctttctgaaaaaaattagtacatttatacagtaagtcctcacttgacatcataggtagagtctttgaaactgtgactttaagcaacgtgtacagcaggtccttgaataacattggttataatatcgatgagggacaaacatcggtttcattatacattgttttgcttaaagttacagtttccaagaacctatctatgacattaaatgaggacttcgtgtatattcaaatggattctctttctgagtctctagatatagactataatgtgaattctaatcatcacgttatttcctgagctcctgtatgctcagttatatgccttagttttgattttgggtatgctaatcctcatgttaagttccccaccatttggaaactgaaacatcggatgctctatcagcagcctagggatgctcacatttaattaaatgcagctgggaagatacttctttaataattgtttagtctattatcacttatcaagtaagtatatagcagctctaatcttcaggaataaatgactttcacctcccctcttttctgtaaaatgcacaaattgccatgagctcttcttggtattggagctacttttcttttgagggtgacaatccgttcctttactacagtacttgaaaacttgtcctggaaaatgacccaagagaccaggggaaaatgcagtgagcctcctgtttgagggtgacacagtcagtgcttgtctttacctccctccctagctcccaagatctaatgaaaaggatacacaacatatgttcttaagagaatcaatccattctccatcacagagctgggaaagaagaaaggctgtcaccattaaagcagaatttggtgggggtggtggtacagatttctggaatattgaaaacaaatggcctcaatttatgaagaaactaaggcagagagttccaccactaaacacaggcattgtcagaggcgtgccattctcccaaacagagccccagagaaactccaagctcagggtcaacagaaatgaacacagaccttagttaaaaggctgactgccgattgtcatgtctcgctgccacgttgcatataaaaataggaaaacataaacatcaagtagagatgtgtgtaaaggatactaatagtcagagaaacacacatggcccttatgcacataaaaagatgctcaaattctctagtagtctagtagattagtgcaaaaagaatgatgacaacataccatattttactcatttgaaagctgatactatcctgtttcagtaaatgtatgggtgaatggtctctgcctgttggtaggaatctaaaggtatagttgtttctgtttttttttttttccttagttgctccagagctaactcctcggcagtgcacccagagtgagtctaaaagtacagtcttctgggatgacaatttgtcaccatctaacaaaatgtcccatgtcttcgtacagcaattgttctttgacttaacagaaatattgacacatgcagaagaatacaagtgcaggaatataccacataacatggtttgcaatggctaataattagaaacaatttatagagaaatggataaattacagtttatttatagtaaggaaaactatgtttaaaagatctgacagggaaagacccttaagatatattgtttaaaaaaataagcaatgtgcacccgggataatcctaatgaacccaaagtaatcacaagtgtacttacaagaaggaggcagtggagttagggtcagagagaagatgtaaggatgggcacagaggtcagagagaggcgaagatgctttgaagattgaggaaggggccttgagtaaagaaatgcaaaagccaggaaaggcaaggagacaaaatcttccctggagcctatacctcttttgttgttgttgattttcaaacaattacgaacatactgaaattttcaagaatagtaggactttttttccctgaaccatgtgagagtaatgctgacacaaagccccatcattctgaattctttagtttgtaattcctacaaacaaggagattctcctacacaagcaaacataccaccagcaaaatcaggaaattaacaatgaaatcttcctaccacctactctacagattccaccccagtttctccaattgcaccagtcgtatcctttatagtcaaaggatccaggacagggtctcccgctgctttcactggtcatgtctctactcactttcaatctagaggctgtcttctcgctgccttctatcaggtggcaaatgattctgatttgtccgtttctgctgagatcaacttgattaaggtggtatttgtcagatttctccactgtgcatgactaatgttttggaatcagtaaggaaacgtgggactatttaaatatcccatttctttctttgtttcttctttcttttctttcctttccctccctccccctctctctctctttctctctctctctctctctttctctctctctctctttctttctgatagtcttactcacttgcccaggctggagtacagtggcgtgatctcagttcactgcaacctccaccttccaggttcaagcaatcttccttcctcagcctcccgagtagctgggattacaggtgcccgccaccacgcccggctaatttttgtatttttagtagagactgggtttcgtcatgttggccaggctggtctggaactcctgacctcaggtgaaccgcccacctcggcctcccaaagtgctaggatgacaggcgtgaaccaccgtgcccagcctcaatattccatttcttatcaaacattgactcactgattttagcttccattgatatttttggatgatttaattattgccttattaatgaccaaacagtgatttttctaactgcatcatttttttctccatttacttgttgccacttgcattagtgtcctattgtgtgtcatactgtattagtgctgctataacaaactaccataaccttagcgggttaaaacaacttaaatgtattattttgtaactctggaggccagacgttccccatcggtgtcactaggttaaaatcaaggcactggcaggcctgtgttcctcttaaaggcaccagggaagaagccgttcccttgccttctagcttctggaggacgcctgcattcctgggctatggccccctcctctatcttcaagccatcagcatagcaccttccctcctctctgacctctgctttcatccgtttatcctctctctgattctgctcctcatggctgctttgtgtaagcgcccttgtgaccacattggggacctcccccccataatccaggattatacacactcatctgcatttaaatctacatattatacataatatagacacatatttgtataatatattatatctttatttatctatataatttttttgagacatggtgtcattctgtcacccaggctggaatgcagtggcacgatcttggcttactgcagcctcaacctcctgggctcaagcgatcctcccaccttagcctcccaagtagctggaactacaggtgtgcaccaccacacctggctaattcttaatttttttgtaaagaagggacctcactgtgttgcccaggctggtctcaaactcctggccttaagtgatcctccgaccttggcctcccaaaatgttgggattaaaggcaggtgtgagccactgcacccgacccttatctatatattcaaaaccatgagtttgcaccaatgcctttaattccaatccaacaccataaggttcagattagttgtcttatcattcaccctgcagctcatttccaacaatgaaaagcctgactcccaccactttcaatatgtttcactattggactaatccctcttgtgtgtgttcagtctcccctcctggccagacccctccactctcctcacactacgcggcctgccaggtgaaaacaatacagggactgccactaagccctactttttttcttttatttttctttctttttttcccctccctccttcctctttcttttccctcccttcctccctccctcctttccttcctttcttttctttctctttctttttgttccttccttcttctctttttctttcttttccttccttccttcctctctctctttctgtctccttccttccttcccttccttccctccccttccctccccttccttccttcctttcttctttctttctttccttcctctttcttttttttcaaggtcagtctggctctgtcacccaggctggagtacagagtggcctgatcttggctcaaagcagccttgaccaccctaggctcaagctatcctcctgcctcagcctcctgagcagctgggaccacagggctgcactaccacaccgggataatttttgtgtcttttgtagagacggggtttcaccatgttgcctaggttggtctcgaactcctgagctcaaatgatccactcaccttggcctcccaaagtgctgggattacaggcatgagccactgggcccagcctgtttttttcttaaatactactacttagaactaaatgtgaaatcatccaaatatcatattatcctaaatttgattaagataattactgttggctggaaaaggtagtattacatatggcttaattcctttactgtatagtccacagagattgagactttaatcttcacattgagtggaaaataagagagaatatgttcagatgacagtaaaataaagtcaaattagactttcagacaaaattacattaaatatattttgacattgaaacaagtgaccaagtgcagttgaggaatttctttgactcatgacatttacagtaagagtaaatatagaggccgggcacagtggctcacgcctgtaatcccagcactttgggaggcagaggtggttagatcacaagatcaggagatccagaccatcctgactaacacggtgaaaccccgtctctactaaaaaatacaaaaaattagcccggcgtggtggcgggcgcctgtagtcccacctactcgggaggctgaggcaggagaatcacttgaacccgggaggcggaggttccggtgagccgagatcgcaccactgcacaccagcctggtgacacagcgaggctccatctcaaaaaaaaaaaaagaaaaaaaagaaaaagaaaaactcagctgttaaacatttcttgctcaaataacttctgtaaaatgcttaatagaataaataatcgtatcagtcagggttctctggagaaacagaaccaataagagatatatatgtatgtgtgtatgtatacatacacatacaaagagacagcgagagagattttaaagaattgctcaagtaattgaggaggccggcaagtctgaaatctctaggacaggcccacaggttggaaattcaggcaggagttgatgttaccgtctcgagtccgaaatctgcaaagcaggccaagccctccggaaactcactcagagtttctgtgctgcaggctcgaggcagaattccttttttctcgggaaaggctcagtctccgctctgaaagccttcagctgattgcatgaagctcacccacattcaagaggataatctactttactcagagtcagctgattgtacgtatcaatcacatctacacaataccttcacagcaacatccaagttagtgtttaaccaagcagctgggccccacagccaagccaagttgagacataatgaaccatcactgtctctgtaactatctgttttcaaagaaacattgattttctttcgcaatcacttccagaagtttgacttagtatttcctacacactgtttaactaacattgaattaactcttagttcctaataaaggtttgctaacacatacatacaaatcttattagaaaattgatttgcatgtgttagaaaacatatttattgcattattttggaacagttttagtttttgcattatctcttctgtggtcatatattggattttctttgatgcttttcactgatgacagctatttgggggaaaacatagatgatttttacaaaacgcgtcactgaaagggtttgggcagacaacagtgcgtcttttggtgcaggctggcactcacacgcagagatgccgcaagatcagtctccacccctcagacctctgcggagggacgcttgggtccggctagttggactaagacagccccggactgcaaggaaaggcctcaaggccccgcccccactcatttgggttctctttttaaagggcaaacccgagtggccttgccagggggaacaaaatgtctgcttgggcatcgggcaggctgggcttaggtgacagctgttcaggcagttcgctgtctggagagcctgttgccagcacctgttgaccttgtgagaagttccatttgggcacagcccctcctgcagggggaggggggaggttctggtcccatttagattgttgccaggcaacccatatcttcagggtcagactgtcctgtttgtctttccacaaagtatacagacaaccataaacaaagcatagcttaagtaacatttagattgttgagggaacataaaatagggcttgttttttccgtccccctccctcatcattgcccaaagatgttactgatttgaaataatttttagatgatctgcgtgcaagaaaaaacacagggacggccaggcgcggtggctcacgcctgtaatcccagcgcttttggaggcggaggcgggcggatcacctgaagtcaggagttcaagaccggcctggccaacacggtgaaacgccgtctctactataaaatacaaaaattagctgggcatggtggcacgtgcctgtagtcccagctacttgggaggctgaggcaggagaatttgcttgaacctgggaggcggaggttgcagtgagccgagatggcgccactatactccagcctgggcaacagagtgagactccgtctcaaaaaaaaaaaaaaaaaaaaaaaacacaacagggacaaatatcccatcagctaacgctgtgatgatgttgtcacaaattacgagtggcctcaatggagtgtggtacttttacaatttactgtttaaataatgcaataaatacaaactacttaagtggtgtatgttcaataatgccacagaactctctaactgtttaatcatttagggctacatttcattatttcatctttattatatttcaatccatcctctatcaacaccatagcaaaccttccctctagacctgtgtatccaataaggcagccactagccacatgtggttatgtaaatgaaaattacaatttactagtttaaatgaacagttagttcttccgtcaccctagccacatttcaagtggtcaatagccacatgtggctagtggctactttatcagggaacacagctaaaggacacttccatcattgcaaaaagttacattggacagtgttgctgacctttggcaggaaacaaagtcttgaattgtctggtgtccaggtttcataaaaagcctgtttacaccagaaatgggcagaaaaaagaaaagaaaaagcctgcttaggagaagcaatatttacggaggattggtggaaggatgcccatctctataatttatttgagttttagcttggaatcaagcaagcccatagcagtgtttctggatcacagagtcttggcactccagaaaactgttttcatggagccacattttaggattttgtccaataactcattaagaaacaaccttgtgagtattgctgtgcagaaagtaaagaattaagcatcatggggacctgtcaaaggacagatgtgctagcctgatgtggcatttactggacaaatctgagagaaattgagcagcaaaataagtaatgataaatggattacagaattaacccagcatgaaaatagtctgcactggccgggcgaggtggctcacgtctgtaatcccagcactttgggaggctgaggtgggtggatcacttgaggtcaggagttcgagaccagcctgactaacatagtgaaacactgtttctactaaaaatacaaaaaattagccaggcgtggtggcacatgcctgtaatcctagcttcttgggaggctgaggcaggagaatcacttgaacccaggaggcagaggttgcagtgagctgagatcgcgccattgcactccagcttgggcaacaagagcgagactgtctcaaaaaaaaaaaaaaaaaaaaaaagaaatagtctgtactgatgtcaattaatatgtggaggagaatgggaagtaccatggaatgccaacaaatgaatgcagagggaataatggaattcgaacatcgaacatcaccacttgtctattgttgtagacataattgttttatggaagagtcagcaaagaaactagcaggttggataggagacaagagatttttatgacaccaaagtgtctccttataagtatttattaattataaagataaaaaatagtaactttacagtggagaaacggcagacgctaccttaaccaagcattcaaaggtaacatcaccagtaatgggaaaagtagatatcttgtgccccctgatgggatacactgaggactcactactacttctgagatgtccctgccgaaaatactgaatctggatctaatgaggaagaacaggcaaccccagactcagaaacactctacaaaagcatctggcctgtgctgtccaaaatgtcaagggcttccaagacaaagaaagatttaggaagtgttccagattaaagaccaaagagacatgatgacaggtacaaatttgagcctagataagatcactgagcagaaaaaagaaaccaaaaaactctttttttcttttgccataaaggtatttaagaaaaatgataacatctgaaaagtcttgtatattaggaaatactactgtattcatgttaacttcctgattttggtcattgcactgtggttacagaaaataacattcttgtttttaggaagtatgcactgtagtgttcaggagtaaaggggcatagtgtctccagctatctctcagatggttcagaaatatgtaattccctcttacagtccaagatctccagcggatgtctggaaccaatccatgcgtatactatatttttcctgtatgggaacacctgtggtaaaagtcagtttagaaacatggcacagtaagagattagcaacaatagttaataaaaagaacaattataacaatatactgtcataaaagttatgcgaatgtggtctctcactctctctcaaaatattgtcaaaccccagttgacgcaggcaactgaatccacagaaagtaaaattgccgataaggggggattactgtatatatgtacgtgtatagagagagatagagagagaaatacattgggagagaggcagaaaaggagaacagtaaagtaaatatatgggaggctgggcacggtggctcacacctgtaatcccagcactttgggaggctgaggcaggcagatcacctaaggtcaagaattcaagaccagcctggccaacatggtgaaactccatctctactaaatatacaaaaattagccagatgtggtggcatgtgcctgtaatcccagctactctggaggctgaggcaggagaatcgctggaacccgggaggcagaggttgcaggtgagccaagattgagccactgcactccagtctgggcaacgagagtgaaactccatttcagaaaaataaaaaaaagtgaatatatgggaaaatacaacaaatacaacattgaggaatctagatgaagagtattagcaacctctttgtacattttttgcaattgtttgtggtctgaaattacttcaaaaatgaaatgaatagaagaaataatcttatgaaatccattactatacttgtgggaggcttaaacctctgcatcccaattgtgaaacttcatatgagcaaattcttacaattaaaacctataaaagctttaattttttccaaaggttgtagagtttctctttttgcctgtttaaagtatgaaactgtttcccttttatccttgacattcagaaagctcagggctaagtagtatctgtagtttctagctaactatagtgaccatggaggaccctatagaaaacactctgtgggccgggcacagtggctcatgcctgtaatcccagcactttgggaggccgaggtgggtggatcacccgaggtcaggagttcaagaccagcctggccaacatggtgaaaccctgtttctactgaaaatacaaaatactgtacataaaaccccaccaggtggcgactcatgctcctgtccccactttacagacggacaaactgaagcacagagaagttagggagcacacaagctcatcagcttagaaagccggagagccaagggtggaacccacgcagccagcactgttaacaaactggaactgtgcggccattcaaaggtgagaattacagagggagggagctcacttcatgcttgcaagaagatctcagcacagagttgaccgaggcaacagttaaacagtcttgaaaataaatacgcgtccacattatattgttacaattttttttttctgaggcagcatcttgctctgttgcccaggctctagtgtagtagtgtgatctgggctcactgtagcctcgacttcctcaggctctagtgatcctcccacctcagcctcctgggtagctgagattacaggcgcctgccaccacgcccactaaattttgtatttttagtagtagtttcgccatgttggccaggctggtctcgaactcctgggctcaagccatccacccacctcagcctcccaaagtgctgggattacagatgtgcaccaccaccacgcccggcctattgcaacaattttaaaattagcatgtggaaatataaaataaaataataattttttattttatatttttcctgaaatttttgtataaataattgaaacgcattacatttattttttggagtttatttatttttacagagtctcactgtcacccatgctggagtacagtggtgcgatcacagctcactgcaacctctacctcccaggttccagtgattctcctgcctcagcctcctgagtaactgggattacaggtacacatcaccacgcccatgtaatttttgtatttttagtagagatggggtttcaccatgtcggccaggctggtctccaactccaccgtgcccagtcttccatatatttactttactgttctccttctctgtctctctcctaatgtatttctctctatatatacatgtacatatatatagtaatccccccttatcggcgatttcactttctgtggatttagttacctgcatccacccacctcggcctcccaaagtgatgggattacaggtgtgagccactgcgcccggcccccattatatttattgataatgctctcacatatgataccaaagaactgggtcagggaagggaggacttccaggctagagaaatattgttagggagtcacagacgaggcaaaggtatgtgggtgtatatgggtgtgtgtgtgactgagggtgagtgtgagtaagtgtgagtgaatgtgggtgactatgagtcgccctaggacaggagggtgttctggccagggcgggtcccacctggtgccctaggctgctgtgaaggactgtgtggccactcccgaccctgagctggaataagcaggtaagtctttgtctgacttgttttgattaatccaagatgttaaaggagtaggagagctggctgtttctctccattactgttgtgtaggggaaaaaaagaccaatatagatataggattccctcagtatccacagaagatttgttccaggaccccttcagataccagaatccaaggatgctcaagtccctgatataaaatggcttagtatttgcctagaaccatacacatcctcccgtatactttaaatcatccctagattccttataatacccaatacaatgtattgctatgtaaacaattgttatattctattggttagagaatactgacccccaaaaaatgtctgtacatgttcagtacaggcacgattttttttcgagtgttttcgatccacagttggttgaatccagcaatgcagaacccatgaacacggagggctgactgtatatatatatatatatatatatatatacatatatgtatgtatgtatatatatacacacacacacaagtttaaaaactgtctgcagaggagaggctgaatagagaaatgtggtctttgggccaaacactagtacccaccaatgataattaaaaaaagcaggagtaggccgggtgcagtggctcatgcctataatcctagcactttgggaggccaaggcgggtggattacctgaggttaagagttggagaccagcctggccaacatggtctctactaaaaatacaaaatgagctgggcgtggtggcatgtgcctgtaatctcagttactcgggaggctgaggctgaggcaggagaattgcttgaacccaggaggtggaggttgcggtgagccaagatcacgccattgcactccagcctgggcggcagagcaaaaactccatctcaaaaaaaaaaggagtatttactagctgacctggatgtcttacgtgctaccccaggctggcctggcccagctggagtcacaggggcgtaggcaggaggctgcctgcctggagcaggaataggggatgcagaggtcggctacaggcacctggcacccttttctcagcatgaattgtacctaccacctggctacaagtgtgggttcttcccatcaatctagctcataaaaccctgtattttccttcataaaatctactgtaagttgtaattataagcaaatgtacttctacttaacttttaacagaacagcttgcacagatcccgcaaagaaattaaccaaagaaccaaagaaattaacatcatgaacagaggctgggcacagtcatgttgagggtgaccaacttgtcagatccgccttggcctccctaaagtgctaggattacgggcacgagccactgcacccgttttatcactgaaagtcctgtgtcctgggaaacctctcagtagccttactattgggcggtttatcttggctgcaggataactgctggtacatacaggcacctttgtacaaactgggaaaaggaaacccatccttttggcagaccaaccaggaaaaaggttttcttcgtccacattgagactgtctcaagcctgggcatacagcttggtgattcatgtgagccccttgagcaagtacaaacatacaggatggccttgctttgccgggatcacaagcttatggtccaggggttgaattctagcccatggccatatttttttaggcctgtttttttgaatattttaagtacaaatgtgtaaaattcaggagagtctacataaaaacacaacttttaggccaggtgtggtggctcatgcctgtaatcccagcactttgggaggccgaggcaggtggatcacctgaggtcaggagttcgagaccagcctggccaacatagcaaaaccctgtctctactagtaatacaaaaactagccaggtgtgctggtgcacacctgtaatcccagctactttggagaccgaggcaggagaatggcttgaacctgggaggtggaagttgcagtgagctgagattgtgccactgcactccagcctgggtgacaagcgcgaaattccgtctccaaataaataaataaaaatgaaaacatgactttctggctactgtttaaaagatctagtaatgctctacttttcttcttccatggcaataacaggctggagtcacatagcagcggctaactttgaactccacaaatcaccatactccccattacccctgactgtcactgacttggaggctaagtagaaactcatcattccttagtgctttgtgttgttttttttctctaaaccgaacctgcttacattttgtgacagcccagcccctgtaggctttgtggttcttgtctgtttgagacagggtctcgctttgtcacccaggctggagtgcagtggtgtgattatacctcactgcagcctcaaactcctgggctcaagcgaccctcctgcttcagcctcctgagtagctgggactataggttgagccactgtgcccagctccctgtcggttttttagcattcagtccctgctactatctgactctccattgatcacaaggtgagactgcagcaagttcaaaccttacagcctcttggcttaagccagaaagcaagagcatcttccttggagtcctgccaaatctcattgcatactactggttcttagtaagtccagaccaaaccttcctttgttgttgttgttgtttttgagacagagttttgctcttgttgcccaggctggagtgcaatggcgtgatctcggctcactgcaacctccatctcctgggttcaagtgattctctcctgcctcagcctcccgagtagctggtgttacaggcaagcaccacaacgcctggctaattttgtatttttagtagagacgcggtttcaccatgttggttgggctggtcttgaactcgacctcaggtgatccacccgcctcggcctcccaaagtgctgggattacaggtgtgagccactgcacccggcccagaccaaaacttccaacagcacatgaatgttgtatttttgcacttccatttgtttgcaatctcagatttttgatgcatgtctttagggttctggtggcttggaggaaagatcatgtatctactgtgtttgtgtttagatttcagggagagtaaggcttctaggaggacattgctcctgagccatatttggaggaaggtaaaggacaagaggagcgggatgagtatttcagattgaggacgtgggccaagggagaaccaaccgcccatggcgagggagaacaagctgctctggggctccttacaactttcccagctgtctttctccccctttctgtagaggctgatgctatttgtgatgcccatcttctataagctgtcagccagaaacacctgctgaaataaaggccatctgttctgaatgctgaatgcgcggttgttgggatctcccaagaaacacacacacaaaaatgaacttactccaaggaagccagacttgacatggaccctctggggctttgacggcccttggcctccagtggacgtccagaatcagggaagacattgctgtggccttctcggtacactatgggctcccatcaggtagaggtcgcgctgtgtgagctggtgtgtcccttttgactcagggaacatgcttgcttgtctgcactgcagtgagtccccagtgaaatgaaatggcaggtcttcagaggcatgaaaatgccagctgttgtgtgtcatggaaagacgcaccagcctgggcaagtcagaggcaacccagaataaatggatccactgtgaaatgggattaatactggtttctaccccatgtggagatcagagactgggcagttattaatattaaagtggagctttgctgtgcaggtcagcagaaagaggggtagtgagctggagatggatgggagatcaaccaagggctttcatttttgttgtttgagagatactagagcatgcttgtttgctgaagggaatgattcagtagaaagaaagcggatacaagagagaaagggttgatttgtggaagcctttgagaacgttagaggcaatggggtttagaacccaagtgaagatggctgggtgcggtggctcacgcctgtaatcccagcactttgggaggccgaggcgggcgaatcacaaggtcaggagatcgagaccatcctggataacatggtgaaaccccgtctgtactaaaaatacaaaaaattagccgggcacggtggcaggcgcctgtagtcccagctactcgggaggctgaggcaggagaatggcatgaacccaggaggtggagcttgcagtgagccgagaaggtgccactgcactccagcctgggcgagagtgcgagactccgtctcaaaaaaaaacaaaacaaacaaacaaagaaaacagaaagaacccaagtgaagatgtgggcctcgggtaagagcagaggcatttgatcctgtgcaccaggaaatcgaatatggatactcctgtaaccaggatgtagctgtggtgctgggcagatgagttacttaaagcaaacagttttcctccaaacacagaatggcacttaatcagaggcattaatatgagtttcatggggaaaggggacatgaacttaggatatggttgagagaagcaggtaaggggatgggacatgaagttggaactctggggttttactgtagcatgtgggctctgagtgtctatggaacagggcgtctatgccgggaccgggaaaagagatggaagcagaattgccattctttacagtaagttttgcctaggctgtctatgatagtgctgcaagttttgagttaatgactcttcaccaaaatcttttacttaagtgtccacagatctgcctattcctgatctaagctataaatccaagaaactaaattctgttgagccagtcaacgaggatcagtttcagctcggcgcagtggctcacacctgtaatcccagtactttgggaggccgaggcaggcagatcacttgaggcaaggagttcaggaccagtctggacaacatggtgaaaccccatctctactaaaaatacaaaaattagccgggcgtggtggtgtggtcctgtaatccccgctacttgggaggctgagacacaagaattacttgaacctgggaggcagacgttgcagtgagccaagattgtgccactgcactccagcctgcgtgacacagcaagactctgtctcaaaaaaaaaaaaaaaaaaaaaagtttccaccacggggaagagttaagaaaattgctagggaagctgcccagcccaatggcctcagaagagggacaaaattccctggaaccagatttagacatggggtcaagtgtttactttgcagccagacctgggcccactgtctaagtggagatgtctgccacgtcttcccttctgaaacagtcactcagcatttctttcaataacaaatatcactgaatgtgcaaaagggaaatgatttaaaggtgacatttagaaagatgaggaaattttaaactgattttcaacttcttcagaatgacgtttctcctttcacttaaagaatcacaacgtggaggccaggcgtggtggctcacatctgtaatctcagcactttgggaggccgaggtgggtggatcacctgaggtcagaagttcaagaccagcctggccaaagtggtgaaaccccgtctctacaaaaaatacaaaaactagccgggcatggtggtgtgtgcctgtaatcccagctacttgggaggctgaggcaggagaatcgcttgaacccgggaggtggaggttgcagtaagccgaaatcacaccactgcactccagcctgggcgacagcctgagactctgtctcaaaaaaaaaaaaaaaaaccaaaaacaaaaatcacaacttgtcagttaatagggttgcaaatttaaaaaaaagaaaaaaagggccggatgcagtggctcatgcctgtaatcccagcactttgggaggccgaggtgggcaaatcacaaggttaggagatcgagaccatcctggctaacacggtgaaaccccgtctctactaaaaaatacaaaaaattacccgggtgtggtggccggcgcctgtagtcccagctactcgggaggctgaggcaggagaatggcgtgaacccgggaggcggagcttgcagtgagctgagatcaccccactgcactccagcctgggcaacagactgagactctgtctcacaaaaaaaaaaaaaaaaaaaaaaagaattacaacttaagtgcagaaattgaatatatttttgtttttaatcactgactcaatgcagaagtagatgtcctgatttcaagcatgacgcagttggaatgacaggtacagctcaagtggaaaatagtgtaaaacaaattctgcagcttattaagaaacaggaggcttgtcaggtgcggtggctcatgacagtaatcccagcacttcgggaggccgaggtgggtggatcacttgaggtcaggagttcgagaccagcctggtcaacatggtgaaatcccatctctactaaaaatacaaaaattaactgccgtggtggtgggcacctgtactcccagctattcaggaggctgaggcactagaatcacttgaaccccagaggcagaggttgcagtgagccgagactgtgctactgctctccagcctgggcgacagagcaagactcagtctaaaaaaaaagaagaaagaaagaaacaggaggcttaagtaaaatgcaggattttgctctatattatagtttgctccattttataggtagaaaaaaataaaatcttaaagaagttatttgctgacagtggaaagtggtcgggtttttttttgtgtgttgttttgttttttcagtctcagactgaactctctaggacacttgccctgttaagtgggttggtgccagagagaaaacgctctggacactccaactagtggactgctagaattcaccggactgactccctgccacctttggcccaatctaagcactgttctggttcaattcaaggtcgtctgatttgattccactgaaaccctcacaaccattaaagtcgagcagcaacttaagatttagaaaagtggttttcaattttttaaaatagaactcatagtagattttatgccacaacccagtccttaaacacacacacgcccattctaaagcaagccaaaaatgtttcacaaacagtatctactctcagaacacgtattgcattccgatcaatatattctattcaactgttttgttcattaaaaaagatgttgctaaaaatctactacattgattttttttttctttttttgagacagagtcttactctgacgcccaggctggagtgtaatagcgcgatctcagctcactgcaacctccgtctcctgggttcaagcgattctcctgcctcagcctcccgagtagctgggattacaggcacctgccaccacgccaggctaagttttgtatttttagtagagaaggggtttcaccatgttggccaggctggtctcgaacctctgacctcaggtgatccacctgccttggcctcccaaagtactaggattacaggtgtgagccactgtgcccagccctaaattgaatttgtatccactactaggttacaaaccagcctgcctgaaacacacaggtttagaaaatgtatttttctctgttttgatcatttatgtattagaataacagccaagattttataaaccggaaaacatttgatattaatattcaaggacatctgattagaacaaaggtgacaaagtatttattttaaaaataatcaccaccacttattgcctactcttatagtattaggctctttacaaacattttctccaatctcttaaacaaccttgtaatttacggtactcttgttcccatcaagggatgaaccccaacctcacagaggatggccagaagtaacaacacccaaaggagatgaccgagcaagcaagccgatggacttgccacagcgcatggttgccggcagtagataagacttggtggatccgagcgagacaattcattactctcagcacagcacacgacagcagctcagcatgacagagcttggtctcctgaccccaagtcccgtggcacaggccaggctctgcacctttgatagcaagtggtaacaatccagtctcctccctatgggacaaacagtggcctggcagtcgtgctgtggttgcctctacgactagctacacaaatggctacaccctggtcagagcgtggtgggccctgcaggttggcatagtctgcaaagacacgcagggtcccggggcccgtggtggactgactctctcaataattctccactttatagtggaaagacattattttctttttttgtttgtttttgagactgaggcttgctctgttgcccagcctggagtgcagtggcgcgacctcgactcactgcaacctccgtctcttggattcaagcgattctcttgcctcagcctcccaagtagctgggattacaggcatctgccaccacgcccagctagtttttgtatttttagtagatacggggtttcaccatgttggctaggctggtctcgaactcctgatctcaggtgatctgcccgcctcggcttcccaaagtgctgagattatacaggtgtgactcaccttgcccggccgaaagacatcattttcttacatctacacaaataatgtggcagggtatgcattctcgtacatcccccttactctgatgcaaatgcttttctttgatcccctgtctaatccggctcctttgacccaggacatacctgaagatactgatgagtatgggcaagtaatgacacaagactttatccctgtacatggatcatttcacacagacaagcacagacgtggaaacaatttctagaagtggaatttctggaccaaaggcctttgtgattttgatggatattgctgaattgtcctttgtcaaggttgcattagcttacactcaaaacaacttgtgagagagaaccggtttcctcacacctttgatatgtcaccaagctattcagtcttcgccagtgtcacaggagaaaaacagaatctccctgcagttttagtttctcttgtgatgagggtgtgtccttttgtttaacataaatttacatttccttttctgaaactgtcacatctaagagttttttatgtataagtatactaaaagtactttttcttagttttatttatgcaattttttccacgcacaattttttacatttatgtcatcaaatgtaacattttctttatggcttcagagtcttgtgtcatactttgggaaggttgtctcatcctgaaactatttttaaaatctccatttcttttcttttctttctttttttttttttttttttttttgagacagggtgttgctctgttgtccaggctggaacacacgggcatgatcacagattcactacagccttgaccttcccagctcaggcgatcctcccacctcagccacctgagtagctgggactacaggcacatgcaaccacaccaggctaatttttaaaatttttcgtagagatggaggtctcactatgtttcccaggctggtcttaaactactatgctgaagcaatcctcccatcctggcctctcgaaatgctgggattacaaatccattttattttaaaagtttttttcatctctctgaatttactgcgatgttaagagtgagataggagtacctttcctttttcccccagtggctctttggttctccaataccatacattgaagaaactgcatattaaattttctcatatatatatatttaggtctatttctgggctctattttctttcattgatctgagcaggtatcagcacagtatcactttaattcttgctgctggaaatgtttgactaaattttatttttattttttttgagatggagtcttgctctgtcgccaggctggagtgcagtggtgtgacctcggctcactgcaatctccacctccccggtttaagcaattcccctacctcagtctcccaagtagttaggactacaggtgtgtacgaccacactcagctaatttttgtattttagtagagacggggtttcattattgttggccaggctggtcttgatttccagacccagtgatccgcccgcctcggcctcccagagtgctgggattacaggctgagccactgcgctgggccatgtttgactaattgaaagaactaaactcacatcatcactgtttttgaaaaaaaattttttttttttgtctattctggtatgcttagttttccttaagaactttggagtcagcttttctttcttttaaaaatccagttgcagtttcactgggattaccttacttatttataggattgccttatttataggatcagttaaacaaaactagtatcattatcaattgattttttttcaattgcttaggctaaaatccaatttggagttagcttcgatgcctctagctctcccacatccttcgttggattcaccagcaagcccgtcagcagttccttcactatatatccagaaactgaccgcttctcacccactcccacctcccacccttgtcaaggaatcgtcattcttcacccacttcctcaacagcttcctaactggccttcctgccttccctcttgcttgcctattctcaacacacaagtcagatcccctcactcctccgctcaatacataccctctgaaggctttccgcctcactcagtaaaaagcagacttggagcagaggaaacagccagaacaaaggccacaggcaggatcatgttggggaagacgaggggagggccagagctagcaggagtctatggccttagagactagttcacgctaaaagtagccgaaactagttacccccgcggggtggagattgtgagagaagggaaaaagatcttttttttacaaaattaaaagccctgcagaactacttgccttctaaaactatctacatgtatgactttgataaaaataaaaaataagaaattttaaaacactgacatataaaaagaaaaatatagaaaccaacggaaaaatgtaacagatggtatttgtcagcatgcagcgggagttcagctttccttcagcagatggacggacattcttataaccaaaactgcatgattcctcagttatcatgagaatttcaaacaaaaaaaactaacatctatcaatttaaaatttgtgagatgcccgtgggaggtaaagaatattttgttagtgtaatttatcaagtgaaatggcaaagtgacaatggtaggtttagcgatcttcagaaaaacagaagggggaggaaaaggtttgatagtttttttgtttttgttttttgagacggagtctgtctctgtcacccaggctggagtgcagaggcacaaactcggctcactgcaacctctgcctcctgggttcaagcgattctcctgcctcagcatcctgagtagctgggactgcaggccacccagctaattttttatttttagtagcgatggggtttcaccatgttggccaggctggtctcgaactcctgacctcagctgatcctcccgccttggccttccaaagtgctgggattacaggcatgagccaccacaccaggccaatagttttgtgttttaaaaataatcatactgttgcgtagatatttgaaaaaagtgtgattttagtaatacaaaggatagtgaagagaatatgaaagctaaagtgttggctttctgcgaagaagcctcagagatgaaaatctcccgtaggctccagggtccaaatcttcgtatgttccttcacagatgagactgactgtaagcaatgcagaacacctactgccctctgtaaaaacaaacatatggcatgcagcgtcttcttgccgtaggagcaggagaatgaagagccggagcagttaggaggaaaagcttcctccttagtcaattccaccgccatgttaaacacaaagattttccccgattgctttgtgtactctaaaaactgccccagtgttaaacttttaaggttgatttctaatcacccaattatgaagcaaaatattttaaatctgcatccccccctccactccccaacagtttccttcttttctaagctggattctctttcactaacaacagagcatagacgtagtttgttatttaaaatatcaagaatagtttcccaacaggccagacttcgtggcaggcagagaaaaggacctattatagatccagaaggctgcagccaaacaggcaagatcacttaaaacttcccaggtgccagcaataacaaacagaaaacgggcaggggtggggacgcttcctgccttactgtatcaccacaatcaacctattacgacaatttattctggaaactagatttatacaggaagctcagcaagcaaaaatggtattcctctagaaatgggaaagttaaaataattttcttatttttggttctcattagtgagaaattaaggctattaaaattacttatttattcaggcattgcctcttaaaatgttctcagctcttcatataagcaaaaattatcatgcaagaattttcattattacaaatttacaaagtcattaaagatctcattctcaatcaaacacttgctcctctcctcatattgtgcaatgtagctttacttaattgatcttcaggaataatgcaaaaatcaatgataaaagtccttagccctttgaaaggcacattttgtgcctctgaaaattaacaatcttcatataaaagtcgtttcatctttcgcgtgctctgatcagtggctttcacacttttttcatgactcattttaataaactttacatagtgactcagtacccatacatgcacaccccaaactaaagttttcacagggaaaaaaaaccctcttacaacaggtagtgcatgctggtattttctgttcaattctattgtctcccattccattaaaaaatgttagtaaagacccctaattaatttcctcactaaaggaacacaaatttgaaaatcactctgggttacatattacttatttttttgtcacattaactgaaaatactgaaattttgaatcttagatgtccaatccctcttgttctgttttcactctggaatattcaaaggtaaaaacacgcaaacacaaatctctattgttactacatagcatgacttttatatttattatttatttttgagacagggtcttgctctgttgcccaggctggagtgcaatggtgtgatctctgctcaccacaacctccatctcccgggttcaagcgattctcatgcctcaacctcctgagtagctgggattacaggtgcctgtcaccacgcacagctagtttttttgtatttttagtagagatggggttttgctatgttggccaggctggtcttgaactcctggcctcaagtgatctgcctgcctcggcctcccaaagtgctgtgattacaggagtgagccaccacaccctgccaaatttatggttaaagcaatcacagccagccctctggaaacactggccgaatcctcaatactgctctcttctgggaatctggagtcctggttactcgggagcctaggtcctggggaggctgcagtgagttatgatcgtgccactgcactccagcctgggtgacagagcaagaccctatctctctacaaaaaaaaaaaaaaaaaaagaaaagaaaaaccctccgaaaaaattccaagatccagggttaggcacatctacagtaccaagcagggcttggtgaaagcttgaatcaagcaacaaataaaaaaaagctgtggcctgtgacaaaacggtgtggaatgattctaatgctgcaatcaaaaagagaaaatccaaagtgccggccagtacccgtttcattccataggatatttaaacatatcagatttgtcaaggttcactgcaagtgtatttgtcatctttaaattcaatttcaattttttcatttcaagaagttctctttggttttcaaatcttctgataattgtcttgttccccattcagtttatttatttaaaacacactttgagtctgtagagtatcactatacccttgtggctcctgttcccctaagatttttgggcaggctctcatgccttgcttttatgtattgtgatttttgactgtgaggacacattccataaactctttatggggcacctcactggtggtctgggttcaagttgagttctgaaagaacagagatgtgtgttcatttctaacagttacctagagcccctactgatttggttcaactaagatattggcttgaggttttgtctgttttaaaatcatacatagggggaggaatttgggctgaaatccaagtgtgaggtaacttgggggcacaaactgtcaggagtgtgtgtgtatccatacttatatatgtgtatatatatgtatatacttatattttactcttccatccagaaccagttccaagacagaaatttcctcagggctcgcactggaggatgggcctcagtcttacagatgtgtcgggggtatgactccctaacctaggctgatcctggccttcatctcttgtcttctgggcccttgaagctgaaaactaaagctgtccttaacctctaggttccaactttcactgaattttttggcctctaggcattccttttctcctgtgagctcatttgaaaaacattttttaatccaacattttgaatagtttctagtaggagggtacatcttgcaccataaggccatgcagatttataaaatcaacaattctctctgaagtgatctgaaataaaatgtgtagaaaaatcgctgtgtataattcagactttattgcttattaattatgtcactccacaaaattttaagtaaacagacattgagaaaatatactgggagtgttaaacagatgacggcaatattgatgaggctgttcaagtgttttacataaggtaataagaggtaccaccatcaccagaacccctacaaatttttacatttcatataaaaagagtaaaaatagttcattggcatgtaactagcatcattctctgtaatctatgagccataataagcctgaacaatttcagtctcttcagagcaaaacaaagtattttattccactagcagatgtttctccaaaaacaaaaaacaaaccaatacaaccacaaatactacccacacacaaccctgaaacataagttgccatattccagtggtcctgaattttaacatgttttgctctacattaattcaagaaataaaatgagaaacagctttgaaaatgagattaactcctttgctgtaattatacttactctataattcaaactatttagctgaagtcagttaacgagtaaaaaccgcggatacagctcaaactgctcttaacttctttaaatgtttactgttctatcaaaactcagacccaagctgcacaggtgtaacttgaggcactaacaatcttcctaccagacgtaatagttttatgtgttcttaaagctgggcgcatatacaaaatcactgtacatcacacataaacatcagaaacttttcttggcacaactagaccaatagtttcctctattattattatttttaaatcaagcatgtgtaacagttcagcatttaaaagactcccatgtatatgattaaaaagatgctcaggttgagaaatacatttgaatacttgaaaagacactccaaaaagaaacaagacttgaaatgtggttttatgttgaaccatttaggagacctcagttatccaacaactaaaagcacacaacagcagataaataggattttattaaaatcaatgtctccaacaatacaaaaactaaatattaaggcatcttttactcccatcctggtatatgcaagagaaatgttttaagaaagggccagcatttcttactaaaatgctttctagtgtatttggcagatttgtttttatattctcctattccacataccactcaaagcactcatgatcaaacatcttgacccaaatcaagagaaaagtataaatagatattaatttattaaaaggaagcagttcatctttcaaaaattaaaagaaactacaaaaagtatcatgtataaagttcaaataccagcatttaaatttctctgaagtaatttacggttcagtaattaagcaaaagaagagatgaagacttaagagaagaagcctattaatatggattgcactatggagtaactgttcactgagtactccgctccactgggatgatagtttgaaaagggcttcatactcctttaagaaaatagcacatccaccaggataagatcatttaaattaacactgattcttattccccatgcctgtccatttataaagctcaaggggcttcataaagtatactaaacagtaacattttcaccttttattaaggcaagtttgtgaaaataatttaatacaacaagatctcttcatgaactttcaacttacaacctttttaatgtaagaaacatacaaaaaattgtgttttataaaaagtcgcctcaataccagaaaatagtaatgaaagattttgaacccagttttactctttaaagaatgctctttccttgtctcaaattccaagtgctactcatcatccttagagccagttttgcttaactataaaaaaaagagagaaaatagtcaacaagtggtattttctgagttcactatttccatggagtatcaaaattaaactataggcaacgaggcttaagtaacttaaatcacctacagtttttaccacatgtagctacttttcaacttcaagctcagctacttcaaacgggtttcaaaatgtaaccttgacaaaaatctaaactcaacagaacaaggtggtgtgtgggtgggtgagcgggacactcttgaagctttctaggaagtaaactggaaccaagaatatacaaatagaaggtaccatctataaaatgaatgacactcttcaaaagttcttgttttccatcacatattctttttaaaatttttaaaaaataattttaaatgtggtcaaataaaaaaatacgtaacctaagatttaccatcttaaccagacaataaattcttatagttttgaaaatatgataaaagtcttatttttgcattgcaatttttttctaagaaaaatctttggcaggggttggcaaatttggggtaaggggaggcagataaaatacaaagatgattctgatcagactactgctccaactactgagaaaggccaccgcacctgacaactccaagaacactagagagtgtgggaagccatgaaaagcagaaactactaaaggtgttggttctcaaatatttcggcctgaggacctctttccattcttaaaattttttttttttttttttttttgagacagagtctcgctctgtcgcccaggctggagtgcagtggcgcgatctcggctcactgcaagctccgcctcccgggttcacgccattctcctgcctcagcctcccaagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccacgccccaccccaaatctctttattatctagctcagtggaagacagctggcttctcacaaatatgcttcaacagtaaatcaggtataatggaagacagctaacaacagcacagtataagtactaagaacaacctgggttaatatgcacatcctcaacctactgattgagaaaattctggtaaacacaagaaaatacaagcacacattctcttagtgctttaagagtattagtgatggcatcatcaaatgtcatgcagcctctggaaaacgccagagaagtttcataagaaaatgggttggctgggcgcggtggctcacgcctgtaatcccagcactttgggaggctgaggcgagtggatcacgaggtcaggagattgagaccatcctggctaacacggtgaaaccccgtctctactaaaaaatacaaaaaattacccgggcatggtggtgggtgcctgtagtcccagctacttgggaggctgaggcaggagaatggcgtgaacccgggaggcggagattgcagtgagccgagatcgtgtgactgcactccagcctgggtgacagagcgagactccgttcaaaaataaataaataaataaataaataaataaataaataaataaataaaataaaaattaaaaaaaaaaaaaaaagaaaacgggttaaggccgggcatggtggctcacacctgtaatcccagcactttgggaggctgaggtgggtggatcacttgaggtcaggagtttgtgaccagcctggccaatatggtgaaaccccatctctactaaaaataaaaaaattagccaggcgtggtggcgcatgcccatagtcccaggctgaggtagaagaatcgcttgaacctgggaggcagaggttgcactgacctgaaattgcgccactgaactccagcctgagtgacagagcaagactctatctcaaaaaaaaaaaaaaaaaaaaaaaaaaaaaaaagcatttaagggcacacatcatcttactattacgatgcaaatagttttgaccttgtgtaccccctgagagagtctcagggacatcccaggggtccaaagcccacagctggaaactactggcttagcataatagattcagagaccaaattatgtctaggtggtaacctccttaaaaatatcttctttcgggctgggcatggtggctcaagcctgtaatcccagcactttgggaggccaaggcgggtggatcacctgaggtcaggagttggagaccagcctggccaacatggtgaaaccccatctctactaaaaaataccaaaattagccaggtgtggtggcaagcgcctgtaattccaactacttgggaggctgaggcaggagaatcacttgaacccagaaggtggaggttgcagtgagccaagatcgcaccactgcactccagcctgggcaacaagtgcgaaactccgtctcaaaaacaaacgaacaaacaaaaaccacaaaaaaaacttctttcatctcccaagattactggtaatttgaattttactctttgttacaaattggaattttatttctattatcagggactcttaaaaacttctggagctagggaaggaggagcactatcaacacctttagatcagattctttttcttctcactttcagcttagagctgcactaagagaggcaacattttgactaagaaaattgctcattttggagcacagcatatttggaggaaagaatgaatttagctggttaggctatatgttggtatatgtaggacaacatgaagtatccatcaagcatcagtggagaaagtcctgggaaatgagagaatgccggagaggcttcactcatacagtatcttacacaggggaggaagaaatactgtgtctcttccaattgtaagttagggcccaactcccaggaaatatttttgtactagttactagcagcactaagattattttaaagtttcaatagaaaatgcattcaatggaacaaacagctggctttaaaataaagtttaagaaaatggccagggccgggcactgtggctcacacctgtaataccaacactttgggaggcagaggtgaggggggatcgcttgaggccaggagtttgagaccaccctggtctacatggcgaaagcccatctctattaaaaatacaaaaattagccaggtgtggcggtgcatgcctgtagtcctagctacttgggaggctgtggcacaagaattgcttgaacccaggagcagagggtgcagtgagctgagatcatgccactgagatccagcctgggtgacggagcgagactcggcttcaaaaaaaaaaagaaaagaaaagaaaagaaaagaaaatagccctgagcagtggctcatgcctgtaatcccagtactttgggaggccaaggtgggaggatcacttgagcccaggagttcgggaccagcagcctgggcaacaaagtgagaccctgtctctagtaaaaataaaaaaattagttgagtgtggtggtgcatgcctgtggcccctgctacctgggatgctgaggtgagaggatcgcttaatctggggaggtcaaggctacagtgagccatgttcacgccactgcactccagcttgggcaacagaaacagacctcatcttcaaaaacaaaacaacaacaaaaaacccaaaacaacaaccaaaaaggtttaagaatacactgcttgtaaattacctgtatttgtgggtcctcactaaaatcctaatctttaactacccttgcatcccattaaacacttctcacaggagttgtggcactaaatggaatgcaaaatttatttcgtgaagtcctacaaagagaattaatttactatgttaaatattagtgtaacgtatttgaaactacagctaatacaagaaaaatctgagacatgtaggcagcaaaattcaaaatgaaagcaaacaattttaaacagaaacagagcattgttcttggtatgatgaacaaccacgtttaaggtctgtccttaaaaaaacccacaaaagccaaggccaggtgtggtggctgccgccggcaatcccagcacgttgtgaggccgaggtagcaggatcacctaagcccaggaggtcgagaacagcctgggcaacatatctgtctctgcaaaaaaaaaaaaaaaaaaaattagccaggcatggtggcacatgcctttgatcccagctagtcaggaggctgaggatcacttaagcctgggaggtccaaggctgcagtgggctgtgattatgccaccagctagcctgggtgacagggcaagatcctgtctcaaaaacaaaaaacaaaaaccaaaaacttaaaagtaatttctactaagaaagtaaaacattcttttccacatctggttttcttcagtttccatatattgttgataacttggagtcatatttaagaatctgcgttatcttttcttttctttttctgtttttttgagatggagtctcactctgtcgcccaggctggagtgcagtggcacgatctcagcttactgcaacctccgcctcctgggttcaagcgaattctcgtgcctcagcctcctgagtagttgggactacaggcgtgcgccaccatgcccagctcatttttgtatttttagtatagacagggtttcaccatgttggccaagctagtctcgaactcctgacctcaggtgatccaaccaccttgacctccaaaagtgctgggattacaggtgtgagccactgtcccctaagtatctgcattcttaagatgtgcttacatagtcatactatattgtagttttaacttctgcaaattttccattacttaaaaaaaaaaaagatctaaaattgagagtgcagggaaaagaagaatgtaaaaggtatttcaaaaatacttacatgctgaatgtaaaaaaggaaacagacatcccagtgaattccaaaggttgtgaaggggaaaacaaaaaataagaatttcattatttgctggtaataattgtaacaagtttaaagactagaatataaatgttatataccttcacaacatcaacccagttccagcctcgaggaagttctcctttgtgatctagaagataaaaaatagtaactttatttctaagaccaaccagctagttttataataattaagattttatatactactgtacacaacaaataggttaaaaatttaaatgacatattactaagttggaaaaagagtttatcattatgaatcgatactgttctcctaggaatacttgcaaaatattttaggtatactccttttttacatttatgatattgctatccaagacaaaacctgataatgaggaaaaaatatagagatgggttggtaatgccaggaaaagcagttaatccatttattagtttcatgcatttgcatgaagctactgctttatataagaggtcattgcttatttaagtaataagttgtattgttctgtttaataaattagcatttcgcacccagaagctaggctcaagacaggaggactcacaaatatatgtctggcctggcttcaagactaaaagaagggctggctaacttatgtattagttgctgtgatctgataacatattcattatttaatctaacattctttaaaaagggctttaatctgttgggattgcttggaaactagcttataattcatagtctgcaaagtgcttttattattttaacagaatattcaaatttaaagaatagcttaacaaatattatctaaaaattcttcaatttaaaatggcttgatttcctttatgcttgatgtatgccatgcatgtctccactttatgaaaccttaaaaatttaaactcaaaacaagtacattatatgaattttccagctagggaaaaagaaattaacccatgatacttacaggagagaagcaatattactggagctcaattttagatgctatcggttcttttctctttcatgccaagaagaatcgtatccccctggttactggttatagggggcacatcaccaattttggttaactaaaacttagccacagtgccgtggctgtcccattaaaattttatttagaatgaaagctccaagtcacaaactcgtatactgtcattatgggaaggtaatggctttaggtgggcatcatcaaagagatgaaggtagggagctattaatgaaatagagtgatcacaggtcattatgtatgaaagcaatattacctaactgacatagatgctacaatattcaaagagagataaaccaaattctagacaacaaactgtaatggctaacaacttactgcttcagttgtttttagagtttaatgctgctctgacattaggtagaatgaattcttagatttttttatttcacaaaccattaccatttcaaaaatgtattttggaaacaaacacagagttgctatttgccacagacagacattaaacaaaacataaaccacaaaaaaactgccattccattacagaagaaaggacatttaaaaggccctcaccaggccggatgcggtggctcaagcccgtaatcccagcactttgggaggccgaggctggcagatcacgaggtcaagagatcgagaccagcctgcccaatatggtgaaaccctgtctctacaaaaaataacaaaaattagccaggcatagtgacatgcgccagtagtctcagctactcgggaggctgaggcaggagaattgcctgaacccaggaggcggaggttgcagtgatcgcgccactgcactccagcctgggcaacagagcgagactccgtctcaaaagaaaaaagaaaaaaaaaaaaaaaggccctcaccaaaataaaagggtcggttcttctcaataaagagaaactttttaacctgacatagtagcacacgcatagatacatacataagtgtaaatgtgcaagtacacaaatgacgtcctcattttccctaactgtgaaaaagtttacagactgttatcaatttgcaagttttcaggttaaataaagaaaagcaatcaaatattattgttgatatgagctagagtttattatcttcttctaaagaactcttgtttagaacatatgagaattctattcttaaatattattgttgtataattaactacaggcaaaaatgttaaattacttatcacactaagacctaatggtatactggtatccatttcaaatgaaaactgtatttcaaaaaatttttaataacacacagctactaaagaggtaaacaaatcccaaacatgttagagctccaggtagaacatgtttttgtagactatttaaatgctcctcaatctctagactcatttatagttactttgccactcggttacctttttttttcaaatggtgacctcttgtgatgaagtagtagtaaatattttcttttttttttctttttttgagacagagttttgctgttgttgcccaggctgaagtgcagtggcacagtctcggcttgctgcaacggctgcctcctgggttcaagcaattctcctgcctcagcctctcgaaatattttcagtatacatatgtgacccaaaaggtcagtgacccaaaagttcactggcccaaatgttccaagaagaaagagtaagaattaatctaaatatatccaccatatcacactaagaagcaatccatttatctgggttataaaagaaaaaaaaacggctgggcgtggtggctcacgcctgtaatcccagcactttgggaggcagaggcaggtggatcacctgaggtcaggagttcgagaccagcctggccaacatggtgaaaccccgtctctactaaaaatacaaaaattagccaggtgtggtggcatgcgcctataatcccaactactcgggaggctgaggcaggagaatcgcatgagcctgggaggtggaggctgcagtgagctgagatcatgccactgcactccagcctgggcaacaagagtgagactctgtcaaaaaaaagaaaagaaaagaaaagaaacacacacaaacctgttttgtctgccagcttacgcttctgggcttttgaaagttgttcttttttgtcttttttcttacttgatggggctgtattaggagtttcaattgagatgatattgcttatcgatgtctaaaaaaaaaaagaaataattctcagcctcataccttacaacttgtgttacactaaatacagctatatcctgaagtgggttgataatttttacacttatgaaataaaagaatcctatattattatgattcatttttaaaatcaagtgcccttaacacattattggttttactcttttaaaagttcagatcaaaggacgtaatattagttcaattgttataaccaaaatcctgggaaggaagatctgattatcagccttatgttgaagatctgaggttccaaggtaggtttacaattcagttaacttgctattatttggaaatttaattaaaacctttttttttctttacagagcttttctcaatgtgaacacttgacaatttaaacacgtctttagaaaaatcacgtgtgcctacctagaacatcctggttcccggaagaaaaattttaagacacatgggttaatgcagtcagggtatatgatagctaaaatgtaaaatgcttactaggtctaagcatggctgcaaatgttttccatataccacacatttgatcctcagcacaatcttagaaggtagatactatataacccccatttgacagatgaggaactgggcacagaaagattaagaaacctgccgaaagtcacagagttggtgagtggtgcagtgatgtgaacccaggcagtctggcccagagtccatgatcttagctaccaccctccactgctcctccagttgcctcttggggttctgtgtcctgttgggaatgtgaaagccaaaaccacttgcacagaagacaggccttgctgccaacagcttagcccttggttcacaagacaacactaaattataccgaacccctcaaagtcttttagtgcatgacgtggtgcaaaggggcctcatacacagatgcttaacgtcatgaaagaaatatttcctaaaactattctagaaataataataaaacaattttttctattcaataaagtttccacatgctgcaacatctacacattgaactgtggcaagactgtttacaatgaaacaagcctcatgcagaaagcaatttcatacttattttagcactgcataagagatcccttagctgtttaagctttatggagagattaaacaaatattaaaaatactaggttctatgatatctcagttttggtgggcatgttatatatattctagtctttgataaaggataaaaatctagagaatataatatcattttctaggttaaatagaagaaatctgaaatccattgttctcatttaactcaggtgtaactctcactttaacaagtcttcttccgattttgaatatatattaagtagtacaaatttattgctaacagcaaaaccaaaacaacaaaagaatccggcaaaaaaataatcacatactcactgcggaattgatgggattgtgattctccatgaactgctctttattgtctttggcatattcaaacaatgtataggtcatagcggttccaagattagcttctactgcttcctgtagcttggctaatatactctgctttacagctgatgatctacaatgcacaacaaaaataccttgctgagagaaaagtataacagagagtgaaatgaaaagcagtaaaaacaagacactactcacatggtgttgttaaaaaaagcgttcatagatagaattggaggtgtttggggatatgtttctgtccaggaaatctctattaagaaggctttgggatcaccattttcacctatctgaagagaaggggaaatcttaggcttgtaaaaggtgataaaaagacagaaaactaaattataatcttcaaaagggtgaattctttccaatactcatgctcagatcagaaatgtaatattttgaaaagtccagtgacacaggctaggactgagcaggggtgaagggagtctcaggacagtctgactttaatttagtcctagtatagcttcataggttcagtttatgcccatgtcctgtccctaaccagcctaccagcttttctagtaccacgcctacatcttaggtattttttagtgttttccgaggatgaaaataagacatcaacttatccgtgggatacagaaagagaatggacaaaaataattcacaaactcgacacacctcatctttgttttaagttatccaactgctaaatcctaggaggcacaaccccaagagtcaagaaaatgaaatttaaaactgagagaaaaaaggaaaaggcaaaggataagggacaggaatgtcttcagctgctaacaatttctgaataaagacgcccttgtttcttccgctctgctaactttttatttaaacatttttaatcttaaagaaaaactgaaatagtataatgaacactctgacattcatcttattcaccaaatactttctgcctcatttactttatctttccccctctccaccatagaatcaacccctactctcccaatgtgatttttttcccctttggtttttgcttaaacatctaacagtaatgaaatttcctcaatatgtgagtaaagtatcttaagaaaaggacaatcttcttcataaccacaagatcattattacacccaagaaattcaacattggtacaaaaatgctatctaatacataaaccatattaaaaactacccaatcatatctaaagtgtcctttaatagacatcacctcaacccacaaatccataatccattgagggatcatggactgcacgagttgttatgcctctttattctgctttaatttacaacagtccccagccctctcccctggctttttttttttttttttgagacagggtctcactccattgcccaggctggggtccagctgatcacggggcggtcacagcgagctgagatcgtgccattgcactccagcctgggcgacagagcaagagtctgtggcaaaagtaaaaaaaaataaaataaaaaaagaaatcagctggacacagtggctcatgtctgtactctcagcactttgggaggccaaggcgggtagatcatgaggtcaagagatcgagaccatcctggccaacatggtgaaaccccatctctgctaaaaatacaaaaattagctgggcatggtggcatgcgcctgtagtcccagctgctcaggaggctgaggcaggagaatcgcttgaatctggtaggcagaggttgcagtgagccgagatagtgccactgcactacagcctggcaacagagcaagactccatctcaaaaaaaaaaaaaaagaaagaaatcctcccacctcagccactcaagtagctggagctacaggcgtgtgccccatgccagactttaaaaaactttctgtagagacaaggtcttcctatgttgcccaggctggtctcgaactcctgagctcaagtgatcttcctgcctcagcctcccaaagtgctgggattatagataggcatgagccactgtgactggcttcccctgccttttaagccaaaaagaatacaggctagttttcttgtataatgtccccagatctgaactgattcaaattaaacatttttggtaagaaaactacagaggtgatgtggcatcttcccatagcatcatataaggaggcacagaagatcttccagaatcatcactggtgacactaagattgatcacatggtttaggtgatcttctccagatctcttcaacacaaaccttttcattttgtaattaaggaataatctcgctgggtgaggtggctcatgtctgtaatcccagctctttgagaaggtgaggtgggaggatgacttgaggccaggagttagagaccagcctgggcaacacagcaagaccctgtctctattaaaaaaaaaaaaatcatcatcgtctgtggggcaacactacaaaactgtatgaataccttgtttctcaacaacctttcacccaaaggttttagccttcattaacagtccttaactgtaactgaatcaattatcatactggtggttgcaaaatggtgatcttctagtaaaacggtggaatgatacatgaatcaacatctcatccttacacagggctatgctaatctcctctgtattgttattaaaataaatgtagggatctactgatagacctggataaggattatctgcataatagatgtcattggtttatgtttaaatatagatgataaaaagtgataaaagttacctgcttgatgcaatcactacgtccttactcatggcgcatttaggaataaattatcacatgcctcacactgtgctgggtaccgaagatacaaagatagagacaaggctattcctgtcttcagacagatatttatataacttacaaaactgcaatatgaataatagttcaaaagtaacaaaacaaagtatgaagaaatggggaacggctaattctgattcaaagtcagagcagagacaggagacatggcccaaatattaatgtatcacagagaaggcctgagttaggccttaaaggagaggcaggggaataatggacctgaggtgagagaaagatcaaacaatgtgtgcaaaagcatagtactagaaaaaaatacacggggggaaatgtcacaacccattatgtctaaggcatgtgagtggaggggaaagtttggagacagaaacaaacagaaggatttggagtgtcaagtgaaaaaatttcgtcctcattttataggcaagaggaacccagagaaaaacatttttaaagaagagaatgggatgacaacttaaatgcttcagagtgccaactagtactgttggaggactcatggtggagtataagggggaagctaaagaaagtattaaaccggggaagtcaactaggaggctaccagactattccgtgcaagaactgaggggtgtgactcaggccacaggaagaactttacccctggccctttgactatcaacacactgtctcctaatctcatgtatcattcttcttaaatccatcctatgggtcacgtcagtgtccatcttatagtacatataaatgtcctagggcattctgcacaacatgctctaaatcactgccattgtgaatgagatatttaggagagtatagggaaattctcgacctcccatttgctaaggagagagtagcaactggattcaaaccgaagggcctaggacttagctccactgttaactttggacatttgaggtccatggttattacatacttggagatggtgtaaggactgttaagcttgaaagggaattgagaacagaaacttattttctgtgatggtcatccatcgatcatgcataagaatcatttctaatagtttaaactgtgacaatgttaataataactgtaaatcttttacaaaaaaaacttccccattccgctacttataattatttgtgtgttttttttgtttttttttttgagtcccgctctgtcgcccagactggagtgcagtggcacaatctctgctcactggaacctccgcctcctgggttcaagtgattctcctgcctcagcctcccaagtagctgggactacaggcatgcaccatcatgcgtggctaatttttgtatttttagtagagacagggtttcaccttgttggccaggctggtctagaactccagacttgaggtgatccgcctgcctcggcctctcaaagttctgggattaaaggtgtgagccactgtgccccgcctacttataatcatttgaataaaaggtttatatgacttatttacaaaataaaatactgttactattttttttttgagacagagtctcgctctgtcgcagtggcttgatctcggctcactgcaagctctgcctcccgggttcacgccattctcctgcctcagcctcccgagtagctgggactacaggcgcccgccaccatgcccggctaattttttgtatttttagtagagacagtggggtttcaccatgttggccaggatggtctcgatctcctgacctcgtgatccgcccaccttggcctcccaaagtgctgggattacaggtgagagccaccgcgcccagccctactgttactattttatgttaaagataagattaaataatttttaaggttttttccatttctagtatcttatgattctggtacaataaaaacaagtttatcttggttttttaagcttctgaattaagttttcaaacgttaaaaatgactgatgttagggtgatgtttccatttaaatgctacagaaaatacagacataataaatttaaacaagtttaaaaaacaaaataagcatttttagccactttcagtcttttctagaaaagttctaagtgctcttattcatgccatgtcttaccctatattgaaaagaaactggacttaattcccggaaactttcatctccttcataaatagagcgtaatgcttctagttccatctgaaataaagaactgaatgagttttgtttagtggtataaatgaattagaaatagagggtctttactttctcattcaagcccactcaactatgtaaaagcttgactaacttatataaccttagatacttaccacataggtgcatgcagcaacacatgacaatattactaccaatgatacttactttcaaactctgtgtcagggactactaagcactgtacaatgtatgatcgcgctgacttctcaaatcaaccctgtcaagaggctcctattattttctccttcctagggaagcaaggaagtctccctgtaaagccactccagagcaagcgctcttagaacttggctaaagacgaacctgggtgcaaagagcattaaacctaaagataagaactatgaaaaacaatactttcccattatttacatacatttcttttatatgtaatccttcccacagtgatacaaagctctaaaaaacacctaagggcaagaaaaagaacttaagaaaaaggctgacaagtatctacccaagatgagacaggactgtcagagaaaatgtaactagtaatccttgcttggacatagttcttagaacattttggtattacaactgagaagttcatcactgtgatcaccgatgaatacctgagaaaagaagtaaagcaagactgcacttgggtacacgtttaagtttttcaaaaagatgcatgtcatgaattctacaaactaaagatggtgaaagtgggcttgatctacagtcaaaattttagaatagaaattattggctgggcgcggtggctcacatctgtaatcccagcactttgggaggccgaggcgggcggatcacctgaggtcaggagttcgaggtcagcctggccaacacggtgaaaccccatctctactaaagacacaaaaattagccaggtgtggtgatgggcgcctgtagtcccagctactcaggaggctgaggcaagagaatcgcttgaacccaggaggcggaggttgcagtgagccgagatcgggccactgcaatccagcctgggctacagagcgaggctccgtctcaaaaatagcaacaacaacagcaaaaagacattgttgaagaaacagtgtgtgaggaactgggacattaaggagtagaccctaagacctagtaagtatatgaaaaacaagatatacccttcttagatagggaaacttgattggcacaatgaagaaaggcataaaacaccgactatatagatttcagccaggctccacaggtttctcttgctacctttacagaaaaaacaaaaaaaaacaaaatacagaaattcaagccggattcaagaataactaagattagattggaacaaaaaccttactcaagatatagtactactccttctgtccctaatcctttcccatattttaatttatgacttggacaggtacaaaaataggaggcaagtttattaaatttgtggatgacaatttgttgggacagtgaataatgctgatggctgaataagaatccaaaaagtctttgaaaagcaagctaatgatgaaatttagcagggtaagtagaacttgtatcaatactcagatacctaaatgtagaagttgaagatgaaagacaaattgctttgtataaagcacttaaaagatttcagttgacagtaaatttaactagacaaaacagcaagatgccacaattttgaaacaggacatttaaaaaattaaaatctgtccacaaacacgtgattccaggatagtgaagagattaacaaagaatggatatatgaagacaagctaaaaggaaccacttcctcagagaaggtctgagaaactgggcaggaaactatcttcaaagatcagaacatcggtcatctgaaagaagaatgaaattttcttgttaaactggagattcctgggcccaccacagaaattctgattcagtaggtctggggtggagtgcacgcatctgttttctagcaaccatctaaatggttctaaggtaggggactatggtccaactctgagaaacattacactgtatgttctttgctttgcagggagaagaagctattaacgcattcacttagaaattcacccggcaagaatattttagaagagattcagatatcaactagctagcttgttggactttgggtcctttaaaggttaacttccaatccagagattctattacatttatcatgtaaaagtagtaagtttcaagcattatactttaaattaacagtgaacttatctaccacccaataagacctggtttctagtcccgattctaccacgtacttactgtgcagccctgcggctatcatcgacccacctatcaaagttagaaggttcccctacagatggcccgtagcacccaccccccaactctaatattatatgattcaatgtcaaaatggcatctcacaaggaaatatttgagcataaaccataaattcaggtggtacatgaatgctcaaaacagacagatgggtaaaagatttccccaaacaatatggacagaaactcagatgcaccaccagtgtcattttcttccatgagaaatgtaactaactcaattagccctctactagccaagagatttaaagatgaccagactaaaatttaaaggtgatcagcctaactcagtaaacaggcactgaacacatgggattcaaggagagccaagagcactggatcgtgcaccaaggacgctcatccctgttattaagtaaccaggggagactcccggatttgcaaaaatgaaaaatgaggggggaagagtggcagaggcggactcctggccattcacgcgcgcttgggtgggacgccggtgaactcggggcaccccggccggctccgagggcacagggcacgtgccgggcaggctgtccgggcaccaggtctcacgggggcccggggctgcgcgccgcgcccgcgctgggagagggccctgagccggggggctcacctcctggtcctcgttggcactcatcgcgccggtcgcggggcgcctcctgagcggacggcgttcgcaacaacgaagagaaagcgaaggcagcggcccagaggccgggcgtccccctttcgcgcctcggctgtgggggcggcacagtcttggcactggcagacgccaactgcgcgcgccccgagcctcggcagcgcccagccgccggcagtgggctgtgggctacgagccggagccgcggctggtggggcctgggaagtgcagcgtctccctgacgcttggaggagcggcgtaaagttccgggacagcgattggtgtagagcgcggtcactcaggcccagaaagtgcttcctgtgccgggggaggtgggtacagggaagtctcgcctgttggaactggctgtggggctgcggcggtggggacgggccacggcgttctgtgacatccccccgcctcccctcgtcttctcccggctggcggcgaccggcctcagctgcagcgggcccggggcgtggggcctgggtgagtccgggcccggagacccgcggggccaggcgggaccgccgaggaagagagctagctcttaacaatgctggtttgggggcctgcgttttgcaatcccatcgacgggtgcaatcctggcacttctcttttagacccgaggaaagacgcacccgtttctagggcctcccaggtttaagacgggggaataagaggaggaagatatctgcctttagggactgcaaggttatttctctacctttcctcactggagctaccagaacagatactgggaccatggggacggtgtttctcctacgttggattgttgcttctcatctttaacatcgaaacatcatttcgtccccacactgtcgttcctcttttgttcgttttgtagttgaacatctctgaatcccattcttagcagccttgtgtcctaacaccctgaacttccagttagttaaaagaaaaaaaaagtaaccacattaggttttggggtttttttagttgccaatttgattgggtcacctttcttatctttcacgctagtttccagtttacttcccttgcattacttgatctcccatccattattcaccttctatagctgcgcctcctttcgtgtatagtttcgttggttgctccattggatatctgaaaatttctccttccagcctgtcattgaaatccattcgatctgcgcctgtgcgttatcggggttctcattcaaattcctttgctgcagaataagcacgaccatttcaggtgacataggagaatgtggcaagactttctgatacaattttcgtgcagcaattttgggacacatttcccataatttagatctctgctgtccagttctgtagccagtagctacatcaggcatttgaaataggctagtctgaattgagatgtgctgtgagtgtgaaatacacaccagattttgaagactcagtacaaaaaaaggtaaaatatgtcattaataacttttatattattgtcagtatgataatattttggacatactgtactgcgttaaattgaatattaaaatgaattccatccacgttttactttttaatatgactgctagaaatttttaatttatttatgtgacttgtatttctattggatgacagtcatttttagttcctcttatttcaactccatatttaaagaccacagctatgtcttttgggcctctggagttattacaggaaatggcctctagtctagactcgttcatattaagcaaaggggcccgtattgtattttggtcacttgttttttgttgttgttgttgagacggagtcttgctctgttgcccaggctggagtgcagtggtgcgatctcggctcactgaaatctccgcctcccgggttcaagccattctcctgcctcagcctcccgagtagctgggactataggcacgcatcaccatgcccggctaatttttgtatttttagtagagacggggtttcaccctattggccaggctggttttgaaccgttgacctcgtgaatcgcccgccttggcctcccaaagtgctgggattacaggcgtgagccgctgtacccagcctggtcacccctttttaattttcattcctacattacccagaactagactgtttctttctctgaacatgcaatcctttgccctcataacttaatcctgtcctaaaaatatttaaacaattctaaaacaatctgttgtagacatttctggcaagctttgcaaatcatttattgaatacctgttgttctttcagtatgtaaacatgagaagactaatagtctttcctaaattaacctttcagttgaaaatattccatgttttggggattaggtattagcctaagtgtgcctcacttttcacaaagattgtgttagacttctccataatatactggtatactggtgtagattacctttttttttttttttttttttttttgagacggagtctcctcgctctgtcgcccaggctggagtgcagtggcgcgatctccgctcactgcaagctccgcctcccgggttcacgccattctcctgcctcagcctcccgagtagctgggactacaggcgcccaccaccatactcggctaattttttgtgtttttagtagagacggggtttcaccatgttagccaggatggtctcgatctcctgaccttgtgatccgcccgcctcggcctcccaaagtgctgggattacaggcgtgagccaccgcgcccggccagattaccttttaaaagagcctcatgacacattctttttcaaataagattatatttaaaatgtagtgataattttgtttggaataacttttttttttttttttttttttgtggcacaatcttgctctgtcacccaggctggagtgcagtggcacaatcatagttcactgtaactttaaacacctagactcaagtgatcctcccatctcagcctcccaagtggctgggactacaagtgagcaccaccatgcccggctattttcttttttatttcttttagagacaggatctcactatgtttcccaggccagtcttgaactcctggcctcaacaatcctctggccttgtcctccaaaagtgctgggattataggcatgagccacttgtgccttacctgaattctctgtaatatgctggtatagattatcttttaaaagaacctcatttgggaggccaaggctggcaatcgcctgaggtcacgagatcaagaccatcctggccaacatggtgaaaccctgtccactaaaatacaaaaaattagctgggtgtggtggtgcatgcctgtagtcccagctactagggaggctgaggcaggggaatcacttgaacccgggaggtggaggttgtagtgagctgatattgggccagtgcactccagcctggtgacagagtgatactccgtctcaaaaaaaaaaaaaaaaaagaacctcatgttgttacatccttttgcaagtaagattatattaaaaatataatgacagtcttgttcgggataaacatagttttatatacttataaagtcagggcatacgttagatttattatggactgattcttagctaaaggacgcagtggaaacatcctccgagaggtttccattcattgttagtttttcccttacagatttttctttaaagagtaaattttatattgtgggaaatgagacaacatagctactatttagataattacataaattaaaggctattttaataatatcctaggtattcagaaattcaatattagcaattacagagaaattaggggaagtttattatatgtaagtcaactgtttttcttttatatttttctttcaatatatttttcttttatagttgaaatagatcatgtagatctattttaattttatcaccttcttgctttcttggtctactaatttcaaagttctgtgtgcattttgagacattactgaaaatgccgatttgtcttaaagttgacttcatttttaacatgaaagattttttcttaaatgtcatatagttattacattttaatagatctaattcaggaattaaagttttccctttttctctcttctgtttgtttgacagtttgcagatactcaaagccttttgcctttttgtaatgattattttatttattttattttttttgagacagagtctcactctgtcacccagattggagtggagtgccgtgatcttggctcactggagcctccgcctcctgggttcaagtgattctcctgcctcagcctccaagtagttggggttacaggtgtgtgccaccatgtccagctaattttttgttttttgtttttgagacagagtctccctctgtcatccaggctagagtgcagtggcgccatcttggctcactgcaacctccacctcccgggttcacgccattctcctgcctcagcctcctgagtagctgggactacaggcgcccaccaccacgcccggctaattttttggatatttagtagagacagggtttcaccgtgttagccaggatggtctcgatctcctgacctcgtgatctgcccacctaggcctcccaaagtgctgggattacaggcgtgagtcaccacgaccaaccaattttttgtatttttagtagagacaaggtttcactgtgttggctaggctggtctttaactcctggcctccagtgatccacctgcttcggcctcccaaagtgttgggattgtatgcgtgagccaccatgcctggccttgtaatgattatttttttgtaatgatttttaaatagagattcatatattggaaatgaatatgagttgtttttttttttttttttttgagacagagttttgctcttgttgcccaggctggagaaatgaatatgagtttttaaaaattaattatgaatgtattaacatttgtatttcaggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaaggtaatggcattgtgatggcatgtgttctttccttctctctctctatgtgtgtgtgtgtgtcttttttgttctgttgtgtgtgtggagtttatcaagacagtggtcacagtggtgcataaagaaagccttaggcattttcatgtaatacactgcatgtatatttaataatagttctttttttttaaactccagaggaataattactttataaagctttctatcctatgagcccaggttttcccttttttgtttttaggaaaaaacccaacatagtcccctctaaaaggaaggtcttgcattccccaccatcattactaatgtcgtttttgaatcccatggtctgtgcaatgtggctcaatttcacagattttttgagcacttgctttgtgataggtacctggaaccatgcaacaagctagtgatacgaatttaagtgagacaggttccctattcttgaggagttttacataaactaacacagtttattcattgcggaatgaagaaaggtattaagttcaaaactgacttttaaggtgaacgacatagtaaagacgactttaccttagataataattattatcatgatgatagtatcactaatagctaacatagttgtaaaaaaacagtaaaacagtttactgttttaagcagtttatgtgtagtgatttgttatttatcataatcttatgaggttggtttgaaagttaggtgataaaacccttttagttctgacccctatcctttttttttcttttgccctagagcagtgtctctgacatagtagtctctggaccaagtatgtcatcataacctggggtatttattaaaaatgtagattgcagccctcctctttggtttctgggaatataggacttggtcaccggctgattatttttgtgtgtgtttgagaaccacacgacaacatttcatatactcagccctggaaactgagctctctgaaattgtgcaagtaatagcatcccagccctggccctcacacgattatttttcttttctttctttttttttttttttttttttgagacggagtctcgctctgtccccgaggctggagtgctgtggcgcgatatcggctcactgcaagctccgcctcctgggttcgtgccattctcctgcttcagcctcccgagtggctgggactacaggcgcccgccaccacgtccagctaattttctgtatttttagtagagacggggtttcaccgtgttagccaggatggtctcgatctcctgacctcgtgatctgcccaccttggcctcccaaagtgctgggattacaggcgtgagccaccgtgccaggcctacatgattatttttctttagtgtcatgtttgtgtcaagaaggcagggagcccagcacaagccctcttttctcttaatgctcgaattcaagctgcttttcatttctctattcccagcttttggctgagtccccatgttattttgtgtcagacttccttattgacctcatctttccttgctggaggtagacattggatcaccatgaagtggagtagtctgagccagcacagctgatttggaaggaatgtgaggtttcaactgcatccctcagggctaacactcaaatctacagcatcctcttcccactctgtggcactcagtgcccagactcaagtggctgctgtgaagcttctgtttaagaattgttctctgctttgtacttcatctacaagtgaggtgaaatgcatcacagcaatatgtctttgaaataaacaaagcctattggattttagataatattttatttgagcagttttacaagaacagaagctggaatggtgaagaatataagtagaatttacctggaaatgggctacttttttttttttttttttctttagcaaagtatttgagacccttgacatcattagacatgcatcatcgttttatgcattcagttatggggctgatagaaactctttggcttcagtcattctttaaatgggaagtatagcttctccagggttgagattccaccttcaacacttactagttcttactgaatctgtaagcctgagtttcctaatcaaaaatgggaggtgtgtatattgaatgagatcaatgcacataaagtgcttggcactcagtaacaggtggtttctgctcctgtcaggtaacttttcaatttctgccaatgtttgcagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggtatgatcttctgtgtcagggcagctatgtcagtttgcacatgtgtgttattcactaacattccttgaaggcaatggagtaccgttcagactgcagtggtcactttgcggattgacctccagtgaatcttgttcacttcctcacaggtagcataattattgactgtatataatgctgggtacgtgaagaaatttagaagactaattggtctgaatttccaaatgtttttcttgtattatcttttttggagacatagtaatttactgtttagtctcttaaaacgctttgctttatcactgtttaagtttcaaataattaattcttttggatgactactctgcagtgtatcaccataaagaagtaagttgcattataacttttacgtaaaagtatacattaatcttttgcttttaaggaagatttttaagattagaagatgtgagatcatacttttagaatttaaatcattgtgacatatatgtgctttgtgtgcaggaaaagatttcttctgatcttggtttttttagttgaaatttatcttcggttgaatgaccaaggttgtattttatgtgaagtcatgaatacattttttaagttaaaataattaattttattcttgctttttcattgcaggcaaagtttacaaggaagaaacacaaaagttgcagtggttctgattcagaagaaaacccctttgcccccaggtatcagaagtctaattaatgaattaattgttttatacctccaattcttattaaagggagataggggttttttggatgtttaaatcttttatgcattcagttatggggctgatagtatgttaactttaaaaagcaccaatgatacatgaacaaatgcttattgtaaaaaattaaagatagtgaagaatgcaaatctcaagttcccctagttcccctgttccacttgtcttcttatgtaggggatataggaaggcatgttcaattcacaaaacaattcgcttgaatttttttacaagagtataattttttttgacttccaaagctttccaaaaaagaatataatttacttatctaagatctatttgaagctgtattccttatatgaaattttttcattaattttctgtagggcaaagaaaaaggctataggatttgtagttttctcttggaaaatgtcttagtttcagattcttatttccactttcccagacttttgtagaccaaaatatatttttgtttctgtgttgaaacttatagcatccaaaatggttttggagacttctttcatgaattattgcttccagttttagttatgttttttgaaatagttatgtggtatatctgttggcattacttggccacctatcctggctcagtagaaaattccacagtgttttcctaaaaggcatatactgtgtaacctctaagaaccacacagagctctcaaggagcccaggagtcctgttggtgtgatgaaaagctgtttgggtttttattcctaattctattttttcagacttggggaaatatttatttgggaagctacattagttattttatttctcattcatcttgatggggattatcaacaggagaagatgtcattgcttcagaaagggctgcagctttatgcaatgcatgtgaactctcaggaaagtctttgtttgtactgccgcacactgaccaccttgtgggttatattataaggtaagtagaggtcttttaaagttttgtttttttagattattaagaattgagaaattggtagcttagacccatttatttttttaaaaaatcatgttcatgaaaaacattcatatgatacagaggctatggggtaaaaataaaagtcttttttgttaaattcttaaccctctccaattccctgaggtaaccagtatcaacagttgctcaagtttccttccaaaaaaagtctttttgtataagaacaaatatatgtatttctttatagtatccataccacacacacaaacacaaaaacataaatgtgctcatatgatacacagtgatcttccacttaacattacctcattaacatgcttccatatgtgcatctaggtcaactttatttaaagaaacaaagtttatatgtttctccattatactttccagtaattacccatgtccttgagtgacatgtatgtccttttttgtgagagtgtctccattccactctggcctgtttttgcttcattcttgagctgtcgatgtatctatgtcactaatttcttaggaaggtgtgagccctatcatatcttaaatatttttataaagcctttgtgtataaagggcagattacctggagacacaacattacctcaaaaatcatgtggtcattattcattgttttgtagcatttattgtcacacagaagttttgtagtagtacattttatgctaggatgtatttagatatgaatattttcattgattttgactgtaaaatggttttccttttcattctgcataagtgtccttcgttaactcatgaacagttttatttatttttgagtattgcttctcttgcatttgtttctttctcagaagcaaacctctgaaaatgatccgctgcaggaggttacctggccttctcactggtatataaaagaccaggcttctaagaaagagaagcatacatttagcagagaacatgcagaggaataggatcaaatgaaaagatgaattgcaaagaaacttaaatgcaattagcaaaataaatctttacactggaagcagtaaacagtagaattcacaccacagaaaatcaagtccatggtgcccagggtaacattgagataattgcttagaattcagaggaaaagaataaatgagttttattccttaaatgcagacatatgagcaatagggaacagagagaagagaggggcagctggtagcacactcaggcagcttttctttccactgaggctcatcccagcatcacacctggcctcagctctccaggcctggacagctcaccattgactctgcacttcagtgctttcctattcacagtgctgttccttgtcagatgctttcatagtcatgcccacctgccagctctccttttctgggctctctcttactcaacatttaaggcttcaacgaagccttcattagaaagctgttgtcctctgtgctataccctgctgtaatgactcttcactgagcagcattaccttccagagactatttggcaatgcctggagacttttatgattgccataactgagggggttgctgtattggcttccagtgggtagaggccagggatgttgccacacactctacagcgtacaggacagccctgcacaacaaggaattacctggccgaaatgtcagcagtgctgagcttgagaaccctaccttaaccatcagtgatcctgcccaccacagctttcaaatttaggcggtcatggattcaagagaaacagaggatgggcctctgcccttaaccacttgtagttttgttgtggatgatgaaacatttcaataaggagtacattgtcaaaataactgatgtaaaaacaagtgccctgggtccatagcctccagcatgtggatacaagatggggagtgcataagatagtccattggagatgaggaaactcatagaccctttcttcagatttatattttatcttcagagagagagagagtaaagctgaatatcaggacatcttcatctcattgatctgggagggaagtagtggagctactgatggcacacttactcctgtgctttcagagcctttcgaggtattacctatacatgctacaatgatttcattagtgtttttttaagtgtcaaaatgttagaatcttgataaaacttctgtaatgcattgggagtgattgtgcaaatcttttgtattggagaagtttgctgatcatttcaaggcaaaatacaggagttgtccaagttaatgattcgagtaagcttttttcttttattaaaaagtaagtgttcccaacgttcagacctttcctcttaggacaataggctgtctgtgtcatgcttactagcagctgtttaaaaaccacgcacatactttgcctttcaaaacaaaggtgacagtttaataatgagtaagaaagcaaatgcttctcaaaggaaagttgtgctatagagagaatatgccaaaaatggctctggaaaatattggaagcagttttcttttcttttcatttttaagatggaatctcattctgtcacccagactggagtgcagtggcacaatctcggctcactgcaacctctgcctcccaagttcaatcgattctcctccctcaccctcctgaatagctgggactacaggcatgcaccaccacacccggctaatttgtttgcttttggtttttggtttttttttgagacaaagtctcactctgtcgcccaggctggagtgcagtggcgtggtcttggctcactgcaacctctgccccccagattcaagtgattcttctgcctcagcctcccaagtagctgagattacaggcaatcttggccaggctggtcttgaactcctgacctcatgatccacccgtctcagcctcccaaagtgctgggattataggcgtgagccaccatgcctggcctaatatttgtatttttagtagagtcagggttttaccacattggccaggctggtctcgaactcctgaccttaggtgatccgcccacctcggcctcccatagtgctgggattacattcatgagccactgttcccggccctggaagcggttttctaattagtttaaaattatttgaagcaaagaatttccatgggcttgaactccgttgttaaaaatacaaaacgatgtatgcagatgtacagattcatgcagttagatttttgtctctgatcttcgtctttccataaattaaaaattggaactgctgtaagcatttggctgggcgggacagtattgaagcagtgtttcactctcccttctgtccccttttcctgaaaaggctggaggagaaaggaagaaaggatgtaaggaccccacccctcatcccccgcagccccaactgctgctcctgcttctgctcttgtgccttttatttgcagcctttagcacaggatctaccttcaatataacttccttttaagtatacagtagtcctccttttgtcctccaaagttgtgtgaatatttttgcctcttaggtactttacaaaattcgggaacaccccttttagacataaatctgcatctataacttagaagctagaatgtccttcacctgaaaaccggtagctctctttcctggaatcggtgctcgtttttcaaagttcagttgcagtggctaaaatatatgtttgtatgctctgaaaaatgtgcttgcttgatatgctagtgcagtggtggcagaaaatggactccaggtgatctttatatgaatattgctaagagtaaatatacatgtgttctaataaaaagttagaataaggagcagctcgtaattaaaagtttaacctaaattatctggtaggataaattctatttcgagacaggtcaaacaataaaatacagataattgtgtgcgtatttgtatatgtgtatgtacgtgtgcatcttgtctagctcaaaacaagttgatcaggttcctaccttcataaagaagctgatttaactgtggagaccaaaagcatccatgttaaattccacagagcactgcaagtgtaaattctgtaatatagtttgtaagtcttacaggatttcagagaagaaataaatagatgtgacctgggaaggtttaaggaagaggaaggcctgcaactgtgcttgaaggtgtggattagtgggaggaagtagtggttattttggacagaggaatgtcataaaaaagcatggacatctgaagttcagctagtttaaatcactaaatgggaagactgaatcggttggatttttttttattgtagaacaaaaaaaactgaaggtctctttccttaaaagagcattcttaatgtttggtgttgccttaaaagtgtaatgtttgagtatctggtaagagaattggtcttttcactaacagccttatgtcttgactagatttgtcgtttatttatttatgtttgtgaaactggttataaggttttctccaaataagcctcaaataataaagaagtgtatgaattaaaaagtggaagccttacaacacttatgctctatcccgtgatgtctctgtagcctgttacggttaaagcgagggaaagatttgactctgtatccctcagtttagaggaaataatagcacttaccaagcctacttactctcagtcttctgtattgactgtttaacaggtgttttatctctaagtacacattcagcttgaaaactaaaaccacacttatctttgatatttactgagacaatctagattaataatactgattctctattgagaaggattttttgtttttgttttttgaatcattcagaatagtctgtagacatatttctggctaccataacattagatattctagtcagtgccttgttgctacccgttcgcaaattttttttttttttttttttgagatggagtctcgctctgttgcccaggctggagtacagtggcgtcatctccgttcattgcaagctccgtctcctgggttcatgccattctcctgcctcagcctcctgagtagctgggactacaggtgcccaccaccacacctggccaattttttgtatttttattagagacagggtttcaccgtgttagccaggctggtcttgatctcctgacctcgtgatccgcctctgcctcccaaagtgctgggattacaagcgtgagcactgtgcccggcccccatttgcaaaatttaaaggatagcttaggttaatacattccttcacacattatttggttcaaggttagattctaattttgtcatattttaacatttttaaaactacagttttgaaaatagaaaaatcttaaaaggccggacatgagggtttatgcctgtaatcccaatactttgggagatcgaggcatttggatcgtttaagtccaggaatttgagaccagcctgggcaacatggtgaaaccccgtctctacaaaaaatataaaaattagctgggcgtggtcatgtatgcatgtagttccagccactctggaggctgaggtgggtagatcactggagcccaggaggctgaggctgtggtgagacttgattgcaccactgcactccagcctgggcaacagagcgggaccctgtctcaaaaatgaaatgaaatgaaatgaaataatgaaatgaaatgaaatgaaatatcttaacctagaaaatcaaatataaaatataatagctgatatttaagttcgtcttttatctggctatgagttctgctttctttcacgccctaggcagataactcctgataacttcttttcaccaaagaaagcttgagttgtgtatccatctctggtcagattttcttgttcctatgtaagttatagaatgatggaggatttaaatcacacaaatgttttcaccttatttgccagttctcatttttggttctttccccattagttttcttattcttttaaatcctaaatactaaaatcaccaaaaaactgaaatctaattgattaataatttttttcagactttttataaaaatataaaatagtaggggcgaatgtgcttttagagattccaatcaaattttaggccaggagcggtggctcacacctgtgatcctaatcccagcactttgggaggccaaggtgggcggatcacttgaggtcaggagatcaacaccagccctgctggccaacatggtaaaacctcacctaaactaaaaatataaaaattagctaggcatggtggcacatgcctatagtcccagctacctgataggctgagacacaggaatcgcttgaaccagggaagtggaagttgcagtgaaccaagattgcgtcactgcactccagcctgggtagtgacagagccagaccctgtctcaaaaaaaaaaaaaaaaaaaaaaaaagattaccaagtttttatgaatcagagaaaggtatttttatttgttgtatcctgtattataaataattttaaatggcttttggatggtcttgtttttagactttttgatctgaaaattcaggttatcttttgcttcactttgtcttattcataatgtaaaacagatatttctgtcaccattttactttcaggtctcacaaatattcttgaaaagtttggtttaaaataattcaatatgtaaatgcttgtttgtttttgttttttacagattggaaaatgccttttatgaacatgcacagacttattactacactgagatcagaagagtgaaatctcataaagaatttttgaataaaacaacacaccaggtgcgtgattttttgcaataatagaagcattctggagcggattattattatttttgaggtgattattacatgttcttaatactttaatgttttaaatggtttcagcatttctaaagtttttttcaatgcttttaaaaattaatttgtttttaaattaaactctttgcttttaaagttcttaaaggtagatttttatagccttcttaattgtgcctttatttgtgggaataattcttgtatttcagttttgaatatttttcttcattcttttatgtctcctcataataaacattataattttcacattttaaatagaatatgtataatagtaatttttttgtctctttttagcttttatttgttaggcatcagttcaaaatagctttcttcagtgagttgaaacaagatacacaaaatgcgctgaagtaagttaagctttcaaactaaatgtttcctatttttatattaacaataacatgtgatggaaatttctgaatctcagccaaagtataattaagtttaaagtgttcatattgcttagatttaggaattagtgtagagatgaatggagtataatattttaggatttttaaaaattttcattttattattggaagtaaatttcattgtgtcataaagctttctggtttgattaattaaattttatgagccacagaaatgtaatattaaaattttccccatcttcttgactttattttgtgtatactctgtaaaattcttgtaagaggctgatttaaacattatctaaatcggactttgtttttccaaaataaatttttaaatgtgcctcttcacaaatttgcatgtcatccttgcgcaggagccacgctaatcttctccgtgttgctccaattttagcatatatgctgctgaagtgagcaccagactattgatttttataggtttatacactagtacatttattaaattcaattttttaaattaaattttaatgttatcagtcagttgcatcattttccatttgaagtctctgcttagagccttgaagattagttgcagatgtgttggcagtggttaaatattttagtcctttgcttttacgaagcagaattcaatgaaacttgacctctttgtagctttaactcactttttgaagacaaaggtattaaaaacagctatttatcccaaaattgaggagggcaaagaaaaatagaaataaataaaaataattttattattcacaggaatattgcagaaacatcttatttttgttgttgttttgagatgtttaagtaccaaagcaccaagttgtgtttcctgaatctcaacaacttcatataactggctttaatgtagttcattttttttttttgagacagagttttgctcttgttgcccaggctggagtgcagtggcgcgatctcggctcactgcaacctctgcctactggattcaagtgattctcctgtctcagcctcccgagtagctgggactacaggtgcctgccaccacgcccagctaatttttatatttttagtagagacagggtttcaccatgttggccatgctggtctcgaactcctgacctcaggtgatccacccaccttggcctcccaaaatgctgggattacaggtgtgagccactgcgcctggcctgtagttcatttttatcgatggtattagtttaaatccttcaatttcagttctgttcaaaaataattctggaaagaaatacatttacctggaaaagttatgaacaaactttttctatgaaaagcctgttttgagatttcctcatttccttccatgtgcaaggtaggccctgttcccagcaggccctcctttctcaccatgcttctccttcagcgtgagctgcccgaaggacatctttccctgctctgtagactttacctgaggccagtaatattcacttaacctgtagaggtacttggggttaaaaagctgttgacctgtgctgctgtttttttgagatggcatctccctctgttacctgggctggactgtggtggcacgatctcagctcactgcagtctctgcctcctgggttcaagggattctcctgcctcaacttcctgagtagctgggattacaggcttgtgctaccacacccggctaacttttgtatttttagtagagacggggtttcaccctgttggccaggctgatctgaaactcctgacctcaagtgatccgcccacctcagcctctcaaagtgctgggattacaggtgtgagccaccgtgcctggctgacctgtgctgtcttgataccacctttgctaataaaatttctatttgtttgagagcttgtaatggtactttaaaatacttatgttttttaacagaatgctgatttttctggacagttgtccaatttccttttttaagttatctgtttgttactgacagatgttaatgacaggaagaacaacgcacatgtcatggttctgttctttatgaaatcattgattcctctcatatatttaataactaatggctcatttatcaggaaatcagagattgacattattgagctgttgagcactaaaatgttgagtaaatattctttgttatttctagtgatttggttcttagaaatcgtttattaaactaatttatatcattaaccaccctcctcatttaggaattataggaccgcctataatcttgtacacgaattgagagcccatgaaactaatattctggaaattaagactatggcaggatttataaactacaaggtaataattctgcttccaaatacagggaatttgtgtttcaatattaaattatctttttaaaatttgaacatcaaaattaatttcttgctctgaaaagttagtatttgattaattatgatctccccttttatatcctttttctcagaagggcatcgattcttagcaggctatttatagtagttgtattttgaattgataagttctagaggttttaaaagtttggagggttttttggtttttgttttgtttttcagtgggagcaaggaggagttgagaagaaagctgcctgtattactgagttttaaaggataaaattattagaactatgtgacttcttcttggtttaatggcacagaaaagaagtgtctattcaccttagaggaaactttttttttttttttttgagacggagttttgctctgttgccaggctggagtgcagtggtgggatctcggctcactggaacctctgcctcctgggttcaagcaattcttctgcctcagccttctgagtagctgggagtacaggcatgcgccaccacacccagctaatttttgtgtttttagtagagacatggcttcaccatgttggccaggatggtttcgatctcttgacctcgtgatccacctgtctcggcctcccaaagtgctggaattacgggtgtgagccaccacgcccagccagaggaaacttttatacctactgtttgagcattttattttgagattgtctatcacaggaataggtgccctcagaagtcaagcaacggctgtttggtttgcttttagttttttcacattcatcttaaagatgcctgactctgtgttggtgatgtatggccaaatagatactttaattcgctgtttttttctaataggaaaagattagaaacaacccagttgtaagtgattggttatataaattataactgtaaacaaagaaatattaaaagctgttgagaatgaggccgctctatgtagtgatatggaataatacccaaaatatattgcaagatgaataaagtcacagattagcatatttagtgtgatgttgttatttgtataaaaacaatagttttctagaaaggcatacacatacttatctgtgtgtagaatatatcaggaagcatatggcagaaactgattgcctctagaaagggaaattagatggctgagagacaggaatggatgagagactgacttttcatgtgttcctttgtacttaaaaaataaaagtgaaaattgtaacaagcatatggaaataaatttaggctttgtttcttccttttttccttttgccccaaatacatacatattagtactattttgaaatagcatgccagccacaaaattttcaagaatttctgtaatacttgtttgatatggaggtaactttgctttaattatgctacagaaaatctttagctttatgacaagtctaaaactgaaaattgatctatcttatctcaattacctgttggacatagtttattttagtccatgttcttcattggggataatttttaaattctgttccatattttttaaaagcttttctaaagtgtagaataaattatgtacaaatagtgagttattttatttcatttctaaaagggatatataacctttggttttagcataaccattctgatgaggaaaattaattgtattgcaaagagcttcagagaaggaaatttcattgtctttttctaatgttattctcaaaatagtttttaaatgaatatgtcttttgactttctttttttcctttattttgggatcaattttacattttgcagatctgtaggctgtgttttcaacacaacaccccattggatgcaattgctcagttccgaaaacacatcgacttgtgtaagaaaaagattggaagtgcagagctgtcttttgagcatgatgcatggatgtctaaacagtatgttttacattgtccttttagaattttttaaaaatgatacatagtatttggagaaatagcatggactttggttctaaaactgaaccaggttttttgtcactaagtaggtttttgatgatgtagcataagtatgtttctggtaatattgtacattgatattgtatacagttccttaatgggaattatttaattcatggtaccatctttttcattcagcatatatttattgagtctctaccatatgtctaggtcctggggatatagcagtaaacaaaattcctgctgtcatggagctcactgtttgagaatgaagtttaaaaattgctaaaatgaaattgttcccagaaacttgggtgtatttatttgagtggtaggaactatgttgagatctagtttgatggtatatttataaagacttgttagaagagatgacttaaatatagaacctatctgtaacctacagttagtgtgtattaatatttacaaagaaattagaacaaatattaactgttcatcaatagcaccattttaacacagtctgctgaggttaagtttcccaggatgaattaccagaaataagcttctttttcttttcattcctctttatttcttgattttcttttctttaagattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagtaagttactcactccgtattatctagcacatagaaaagttattcttcttttgaaagaagctagaactgattggtgttgataattttttccaagtctttaaatttaattagtttttattttttatagctttaggaattacattgatctttggttttagcctgagtactctgttttcacctgtgaattgagcagaagtttttctttgaagaactaatttttggcagtaagttagtgactatttagacaagagaaaattactttaaaagccacattttcatccttgtcacactataaatccattgttttgtttctatgatcactgctgtaaaagtttggaaatctgttttgacccactggagaggataaattttgacttctttctcttcctggggttttcctgtatggagactctttttttttttttttttttttggagatggagtctgtctcttgttgcccaggctagagtgcagtggtgcagtctcggcttactgcatcctccatctcttcatctcttgggttcaagtgatgctcctgccacaatctcctgagtagctgggattacaggcgcccgccaccacgcctggctaatttttgtacttttagtagagatggggtttcgccacgttggccaggctggtctcaaactcctgatctcaggtgatctgcccgccttggccttccaaagtgctggaattacaggcgtgagccaccgcgcctggcctcctgtgtagagactcttaagagtctgtttgaggagtagtgttcattgcatagtttcttgatgtttcagtttgcctttttcttggaagattacatttagatatcagttttcttataaacacctttaaaataagaacgtggtatatatatataaatatatttatatttatattgttacagtagtttattttcacttaaaacctgcagttctcttctctgaagatgagtgaatattatcagtagtactatttttaaaactgttccaaaaacgaatagattgtatattagtacttaaaatgaatggatttttttctctaaaatgatgatttagctgtttttgccatgctatttgtatgatttgtaattttattgtgtgtattatatttctaaagtttggcatattgtaattttgaacacagtattttaaaaagtgactaaaactaggttttataagaatgtaaggaactgggcattaataaatatcattggttaaaatgtaaattaatgggccgggtgcggtggctcacgcctgtaatcccagcactttgggaggctgaggtgggcagatcacaaggtcaggagatcgagaccatcctggctaacacgatgaaaccccgtctctactaaaaatacaaaaaattagccgggtgtggtggcgggggcctgtagtcccagctactggggaggctgaggcaggagaatggcgtgaacctgggaggcggggcttgcagcgagccgagatcgtgccagtgcactccagcctgggcgacaactctgtctcaaaaagaaaaaaaaagtaaaataaaatttccatcaaataataatttgagaagctttaaaactgtgcatatcttttgacctagaatttaatttttggagataactaaggcagctaataaattctgaaataagtaccaaaatttatttataaagttgttctcacagatttattaattaattgtaaaatagaaataagatgaatagctatagggaatttgttaaaatatgcactagtaagcagccatgaaaaataatgttttagaagaacatttaatgctggattaaatatacagaatatatttaaatgaaagaaggaggttgaaaattaatcattaacaaatttgtgcatgtgaaatctggaagaatgataacatacattcttaacagtgggagttggtagtaggtttataagtaatttagattttcatccttttggatgttttctgcatttttcatgtattacgttttggtttcagagggaaaagttaaaaagaagaaaaagcactgtaaatctgtcagttctggtgccaaaaatattcccccacaatagcaagatttaatacagaagtgataaagaaggaaaatagtgtcttctttgtagaactccttgtaacattgttttcatttacacaaagagcatgtatgcatgcggaataaatatagagcataatttgtaatatatttttactggtttattagagcaaagattaaaaaagtgaagaaattactgtgaaatcatttgtcagaatcagattgatttttatgagactacctaaatatgaaacatttttagcttaatttttgttaaaatttatgttaaaatattcacaaatttgataattgaatatatatttggtggttgtatttatgaaaacttttttgttcagtcaaaggttgggcaagagttgatttgcgatgagttccataaactattatttaggtttgtgttttaatttacaggcttctgtaatgtatcccaatcctgatcccttagaaacacaaacaggcgttcttgacttttatggacaaagatcatggcgacaaggaatactaagtaaataatttttccctctgtcctttcctctcaacctcaaaaggcaacaatagctataatagattttccattggctgcacatgcataagaaattatgttgaagtaaaaatgtgtgctttttaaacattgtttttgtttttagaatgctttgtatgtatcactgcatcttagagtgacttataattaaagttgctgttgtgattaaaacatgtatctgggtgtggtggcacatgcctgtagtcccagctacttgggagactgaggtggaaggatcacacctgtgaacagccactgcactccagcctgggcagcatagtgagacctcatctcaaaaaaaaaaaaaaaatacaacatttggacatctgttgttttaaatgacacatgccactgttgtcttatttaaatattttaattccagttaacttttaacaattgatttgacattttaaaacagcattaactcatattaccttaaaaacaatttctctgcatattttttaatactttatacgtaatttaattcaagcaattgaactataactgttaaattactggctaggcgaggtggctcatgcctgtaatcccagcgctttgggaggccaaggtgggaggattgcttgaggccaggagtttgagaccagcctgggcaacatagtgagaacccatctctacaaaaaaatacaaaaattagccacacatagtggcatgtgcctgtagtcccagctacttgggaggctgagatgggatgatcgcttgagcctaggaggttgatgcgcagtgagctgtgattgtaccgctgcactccagcctgggcaacagagtgagatcccgtctcaaaaaaagaaaaaaaggaaatgattatctccagcaagtgtatcctctatagaggatgatattgacattgcttttcagatcgttgattccagtaggtagaagaacattgagctcaataatgttcccatcagaacagaacacggaagtttccatgttaataaagctgcctcttagcacctttacgattctagaatgttgaagagtctgaaatgattatattaaataaaggtttcaaggagtgtacacatacaacgttcatatgaagatttatattaaatgagctgtctaaaatgagttgtgtctcatcttacgcaggttttgatctttctgatcctgaaaaagaaaaggtgggaattcttgccattcagctgaaggagagaaatgttgttcactctgtaagttttgtgtccaatataaactattttttacactatttaagaaaaatatttgtattgaaatgtttcacactctactttttctaataggagataatcataactcttctgagcaatgctgttgcacagttcaagaagtataagtgcccgcgaatgaaaagtcacctaagtatgtatccacaaacgtcaccattgcatgcaactttgaatgactttaagttacatacataaatctttttttcctttatagtggttcagatgggagaggaatattattacgcaaaggattataccaaagctttgaagtgagtcctgttcactatttacttttacaagtatttggattatctgaagtgaaactgaaatagaaatcagtgttgaaggagttcgtattttcatatttatttctattgttgttaaactccatttctgtaatgtttttttcaagtgctattgatggcacaatctttttcagtgttttaagaaatctcacgtttagctaaatatgagaatacctgttcaaccatctcagtaagatttttctatacttacataaaatgaggaaagtatttttttctccatgaactcttcgaaccctttcttgtgaagccggttcagtattacattttgtcttctttgaggttgctggattatgtgatgtgtgattatcggagtgaaggatggtggactctgctcacttctgtattaactacagctctgaagtgctcctacctcatggcccaattaaaggattacattacttactccctagaactccttggtagaggtaacctgatgttttttgagtaaaattcttgatacataaaattatttagcatctttaagctttttaaaatttaaagaataatttagtcccagataattagtatactttactatgtgcaaatcactgtgcttagtcatcttaaagaggtatttattattatatcaagtttctaaaacaataaatgggggtagtagacttaattataagtacttaaaatgtttttccttctttcttcatactagcttcaactctgaaagatgaccagaagtctcggatagaaaagaacctcataaatgttttaatggtaggttggaattgtttatatagagtgtgttattaggaatatgtgtacttatatctatatcaactaatccaagtagtggtttttattcaactagttgaatggatgttaactctgtgttgatgcagaatgaaagtcctgatccagaacccgactgtgatatcttagctgtgaaaactgctcagaagctgtgggcagaccgaatttctctggctggcagcaatattttcacaataggagtacaggactttgtgccatttggtaggtagctaacatctacagtactatttcagagaaattgtcttatttctacaaaatgaataggtgcagaataataaatataaaagtcaagaaagagttttcaaagtataatcatgttatagataaactgatttttttttgtgtcccctcagtgacttacaaaggtagttaggatcttaaatacttgacttatgttttaaaatacactttgctcatttgtagttcaggtgttattagaaacacctgacagttatttaaaaggttgtgctttactgtctaggtaggtattttgaaataataataaaatggttctttttcatttaaaatcttgtcatctacatttcaggagcagctgtgtttttaaaattaaagatggttttgaagctgtaatttatttaaattttattttatattatttatttgttcatttattttatttttctttttcgagacagggtctcactctgccacccaggctggagtgcagtggcatgatctcagctcactgcaacctcttcctcccaggttcaagcgattctcctccctcagcctcctgactagctgagattacttatgggcgtgtactaccatgcctagctaatttttgtatttttagcagagatggggtgtcaccatgttggccaggctggtcttgaacttctgaccttaggtgatgcacccgcctgagcctcccaaagtgctgggattacaggcacgagctaccatgcctggcctatttattattctttttgagatagagccttgctctgtcacctaggctggagggcaatgctgcgacctccgtttaccacaacctccacctcctgggttcaagtgattcttgtgcctcagcctccctagtagctgggattataggtgcacaccaccatgcccggctaatttttgtatttttagtatagataaggtttcaccgtgttggccaggctggtctcaaactcctgacctcaagtgatccgcctggcttggcctccccaagtgttgggattacaggcgtgagccactgtgctcagcctaaattttatttttataataaaaagttagctcatttgtctcttgaagtgccttaagtgcagaagtcagtaagaatggtcagtgcagatgtgtctttctgaagaatcaatttggttaacaggatgtgtgtgggtcgtgggtatctggttgtgcataacacagcccttttgttttatttctagtgcagtgcaaagccaagtttcatgccccaagttttcatgttgatgttcctgttcagtttgatatttatctgaaggctgattgtccacatcccattaggttttccaagctctgtgtcagctttaataatcaggtaatgatgccatgtcatgtgtttttaccacgtttatcttattgtagcttatgttaaactagataaaatgagcttagtgaattttatgtcttaatggtttcatagtaacaaatgaactttggtaaggtctattcaaaaatatatctccagggccgggcacagtggctcacgcctgtaatctcagcactttgggaggccgaggcaggcagatcacaaggtcaagagatcgagaccagcctggccaacatggtgaaaccccgtctctactaaaaatacaaaaaaatctgctgggtgtggtggcacgtgcctgtagtcccagctacttgggaggctgaggcaggagaatcacttgaactcgggagatggaggttgcagtgagctgagatcgtgccactgcactccagcctggtgacagagcaagatctgtgtcaaaaaatatatatatatatatgtttctaaacttctagcaattcaagtttacactttgcttactccaatttttgttttcactccatgtttataaagtcttaagaattctctgtgtgtgtgtgtatatatatatatatgtacacatatagtatatatatactttttttttctgtcttttttgagacggggtctcgctctgttgcccaggctagagtgcattggtgcaatcatagctcactgtagcctcaaccttttggactcccaccttagccccctaagtagctggaactacaggcacctgccaccacgtctggctaacttttgtattttttgtagagacagggttttgctgtgttgcccaagctggtcttgaactcctgggctccagtgatccaccaacctcagcctcccaaagtgctaggattacaggtgtgaggcatcacatctggccttaaattttttttataatgtatacttgaattccaaataaggtatattcagaatgaatagaattaaaaaaacatttggtttatattttacttcaacattattagttaatgttattagtttatgattatggaactaatttatgtttgacatttaaaaaattgaaatggaatagatggatataatgtgaaaagtaaatgtgtgtcttctttcttctccattctcccacacaccctctacgttaacttcttgaataacctagacattttctgcacatgaatatataagcaactttttttcttgcagaattgggatcatatttcctgcatttgaatatatttgaagcattatatagtatatagtcaagtacttcattacaactctattataaactcacttagtagataatcatcttttgattacccagaaagtatagtgagtctttcaccaacaagcatttattgagagttacgatattcttaacatgctgaatctgagtatagcatatgtcgacctcattaaaatttaggcattttggggacaagggccaggacagaatcaaagattgcccaaataggtaatgaagactaaattacgtagtgtaggctagaaagagggacagctgtagtaggcatgccagaaaaaagggagggagttccaagaatgaagatgaaattacgataggtcgaaaagatggagggggagaacatgtttggcaatgagaaaacactgcatggaaacagaagcgcacaatctgtgtttctgggaaagtcacacctcactagaacagagggtttataatgctgggtggtgggaaataaggccaggtggcttaaaggaacctggaagagttaagcggggataggctagtaaacagatgtctttgaagatttatttgttcttttgtctgtgttctatttattggatggtgataaagaaacgttatctgttttattaggatttgattcataagaaaagagaaatatctctgtaatagaaatgattagatgaagctgggtcacctgaagatcagtatgttctattcaacttcagacccttgcccagggatttcctctaatccgtttgagaattttattttagtgtgtgtgcgtgtgtgtgtgtgtgtttgtgtgtgttttgagacaaggctgcactctatctcccaggctggagtgcagtggcaccatcttgagttactgcagccttagtctcccaggctcaagtgatcctcccacctcagcctcctctgagtagctgggactacaggcacatgccaccatgcccagctaatttttgtatttttttatagagatggagtgttgctcaggctggtcttgaactgctgggctcaaggagcccacccacctcagcctcccaaagtgctgggattacaggtgtgagccatcatgcctggcccagtttgagaattttaaagcaagagcatgcaatttattcttaaagttttaagaaactttattctagtagcaaaatagaaataatatcatggaagccaattagaggctctttatattaatccatgtacaaaagtacaagtatcggaattgagttgctggtgttgggaatggagattcagggatataagaggcatttaaaaatagataaatctggattgccaagtgcatatagcggctgaaaagtggggataggatgaatgaaggacaggaggttttgtacatgccctttcctctgcttgaattggtttgccctcctctccgactacttcattccttcttgccttttctcacttaaaagcatcacttcttcagggaagcctcccctgacttacatgactgaatcacttagccaggctctcatagccttggtagtactaatcacactgtggtttcaccgttgtctgtgtgattatttggtaaattacctgtttttccttactggaatctaagctccacaagggcagaagggcaggggttttttttgtttgtttgttttgttcattatgaaattagagggtcaacacaaggactcttttttttttttttttaaagagatactttgttgcccaggctggagtgcagtgatgtgatcataactcatctcagcctcaaactcctgggctcaagtgaagtatggggactcttattttacttttcccttaatagcctactatttcatttcttttctttccttttttttttcaacaaaaaatataagctactataattaaaaactaataacgctaaaatggaatataaagcaattagttttaaaatttagattatattctgaatatatcttatttgaaatttaagatacaggcggggcgcagtggctcacgcctgtaatcccagcactttgggaggccaaggtgggcggatcactggaggtcaggagttcaagaccagcctggccaacatggtgaaaccccatctctactaaaaacccaaaaattagctgagcgtggtggcgggtgcctgtagtctcagctacttgggaggctgaggcatgagaattgcttgaacctgagaggcggaggttgtagtgagctgaaattgcatttctagtgggcgatggagtgagactccgtcttaaaagaaaagaaattcacaatataaaccataagaaaaaaaaaagtagagtagtttttataagcatggaatagaaatgaaaattggcgggaaagtataatacttgaactgtgtaagaatttctatgaaggtaatttatatgctggaatagaagatggctcttggaaaggtcttgatatttattgaacagatgagaatagtgattccatagatagaaacatgaaagctgtcttcctttactcatctatgaggattgttctcttctgggaaggcagatgcacattcactttgggacgtgctgagtttcagtggtagtggacttgtcctctagacagttgtggatataagcttgtaattaaggaaataagacagaataggacaactgtatgtgagagatactagcaacaatggtatggtgaacgtggaaacaaatacatttccaatgaagtgaacagagagagaaatgaagacctgaaagaaagcaaaggaatggggctgggcttggtggctcacacctgtaatcccaacacttttgaaggctgaggcaggaggatcacttgagcccaggaagtttgaaaccagcttgggcaacgtagtgagaccccatctctacaaaaaatagaaaaattagtctagtgtgatcgtacatgcctatggtcccagctactttggaggctgaggtgggactatcccttgggtccaaaaggttgaggctacagtgagccgagatcatgccactgcactccaggtaggaaaaacaggaagtaaccaagcaggatgagaaacaggaaagattatagcatcacagaagccaagtaaaaaaaggctcttcaagaaaaggaggtgataaacagtagtgtccagtgcaacaaagaacaaactgtttctctgggagagggatagctaaatattttcagaaaacagtttatgtgtagtgaactgttatattatggcagcagtaagtggataaatgcctctatttggcataaaaaatacttccttttattagtaacccttcataatgcttcagtgtttgtggagttatactaaatgagctccaaagcacttggcatttagggttagcagacatctgacatttgatgacccctgttcacctttttcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgaggttagttatgaaatttgttttaaaatatttttaataataaaagtatgtttatatcaatattttaaataatacaaaagttgattaagtaaaaaatgaaaatctgctacttggacttcctaaaggaaaccattcataatagtttgggaagtttccttcagacatttttctgtgaacatacttgtagtttaaaattttttgcaattaaaaaattgagaatatactgtacataataaactgtagctggcttttgtcatttaatagtgtatattagatattatttcttgttagtatataaaccaatcttgttttttaatgaccacataatcagttaaggagttttaaataatgtatattatgtaatatagcaaatatattttttatgttattcagactgaatatcttttgatgtttaagcattactgagtacatatttttaaagaaaaatgaacatatatatttgtaaagattgatatagtatagataattgaaatgccttttagaaatataggatctaagtaatatctttattgagcataaactctggagccaaactgtatgggtttaaattacagctctctagcttattagcttgtggccctgggcagttacttagcttctttgtgtctcagtgtattcatctgtaaaatggggatcataagagtactaatctcttaggatttcatgaggattaaatcagctagttaatgtaacttgcttggaatagtgattagcacacagtaagcattcattaagtgcttgtttttcatgacttgaatgggaatggttagctcatctaaacttgggaccattgctaagataaatggcatataaagttatacaaccagtgttcccataacagtttctgtgaacatgttgcttttattatttgcttattcattaaaaaaaaaaaaactttcatgattttgactaaatgccctaattgcatattttattttttcatggtacctaagggaacctaccagacataaataataattagtaattctattttgagtccttttgttaatggttttagttgaatagatcatgtattcaattaataaagcattttattgctaatactgtaaatatttttgagaaaaatatttgtggagtcggaaatgaggttataatgtatccatagccatcacaatacttatttcattcagcaaccactaattgaaccttcattacatcagggactatgccagatgttaaaatcataacactactgtgcaatcagcctgtcaacagaaagtcaggttagtgtctctgttttaaaggtgaagaagttggaacccagagcgcagttagtctctgtcccagcccgagtaagacctctaatagcaggtgttctcacttctgtcacactgggggtctctagatgaactccatggtcttagcagtcgacgatgtaattttggtgagaggagatggtgacaagcacatatgagatgacatttccaacatccttttttttctttttagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgtaagtctgctttgctaagctgatattaaaggtcatcctcttatttcttttgctattttttttggagacagagtctctctcttgtccaggctggagtgcagtggtgtgatcacgactcactgtagccttgaccacctgagctcaaaccatcctcccacctcaggcgctacccttgccttccccagtagttgggactacagccaggtgccaccatgcctgactaatttttgtattttttctagagatgagggtcttactatgctgcccagccttgtttcaaactcctgggctcaagcgatcctcctgcctcagtctcccaaaatgctgggattacaggcctgagcctctgcacccagcctcttatttcttttaaatactttatttgaataatttatttgctttttttttgatcagttacttagctaaggtttcttttcaaaggatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggtaagcattcctttttgtaagtttgatcagtattaatccaacattaaataagcatcagtgatgtcaactctaggacttttgtttacaagagggtatggcatagtgctcttcacacagtattgattattgggataatgtttgaattctttgttttgaagaaccaatattaactcttttaggacaggatgccaatttaactcagaagactcacgtgactcttcatggaacagaactgtgtgatgaatcctacccggctttactcactgacattcctgttggagacttacatccaggggaacaggtaaacttggtcaactgggattgaagaggaaatcaattagtttgtagttttaaatatatagtgagtttttaacagttcagagcgttttaacgcatattctaggactgaaaaagtgatttaactaatgaacatttcatacacattttacatacgtaaatgtgtaaaatgtcttaagcagtttttctacaagggaatttagaaaacatgcttaacatgaattagtgggctaataaaatacccattgtttgtaacttagtgcagttaacttctcagtcaacttctgcttccaaactagatagaaaaatattttggaagttaaagaacaataatttctaaaagatgcagtagtaatgatcccacccttatactgtggccacagtgtaatcagagtactctactacagtgggagcattgatgagttacattgtaacattctgtaaaagtgataaagaatttagccagttggtataaataaactctagaaggtgggaacattatcctagaatatatatcaagaagaaatgtctgtaatactaattaaattacaacatttattttgttacagctggaaaaaatgttgtatgttcgctgtggaacagtgggttccagaatgtttcttgtatatgtttcttacctgataaatacaaccgttgaagaaaaagaaattgtttgcaagtgtcacaaggtatttttttatagctactttataaagcatcatatgtggagtattcccattttgtgttattttagtttacctataaaataagcataaaataagcagtttaggtgcttatagtctgttataaattttaattaaactttttaaaaaatcacttatattgagatttgtttaggctggcattcactgctcaaacattaaacagaaaattagcttatatggcttttcttttttttttttttttttttgaggcggagttttgcccttgtcgcccaggctggagtgcagtggcacgatcttggctcactgcgacctccacctcccgggttcaagcgattctcctgcctcagcctcccgagtagctgggattacaggcatgcaccaccacacccagctaattttttgtatttttagtagatacggggtttctccatgttggtcaggctggtcttgaactcccaacctcaggtgatctgcccaccttggcctcccaaagtgctgggattacaggcgtgatccactggacccggcctatatggcttttcgtatagaggatcaataggattgagatctcaagcaaatcacacatgagataaaatctgtaagttgacttacatatagagggttctggagaaaaggaggtcgccctttgaaaggcatttttctgttattaaaaaatattggtaaaaattgttttcggtaagtgcacataaaagtgaaaataggaacgatcacggttacagttcacaactcgaaggcaactgctaactctttgtgtttcttattggtctcttttctatttctagagatttttaacaggccatgtttctaaatagattcaattgtgctgtatataatgtttatgttctcttttgttagtagaacattatgatatttggtatcttcttggtcctgacagtaatgttgtcttagttttctcttaggaattgggtcctcagcccagcagaggagaaggcctatagcaatttggggatttgtagttttgttactgcacagagtctgggctgtgggctatttactagtcattgggaaagaaaaccatctcaaaattattagtatttcccaagcgggagagaagaaggcatgtaatgtactgttgaaaatttctcatagcctggtataatacatagagtcctatatggtagcttaggagataagggtgccaatctcagcacattatatgtattatctcatttgatttttctaacaagcctgtgaggattatgaaactgggacttaaagagactgcatgagttgagcatcccaaatctgaaaattcaaaatccaaaacgttccaaaatcttttggaaactttttgagtgccagcatgacactcaaaggaaatgctcccaggagcattttggacttggaatgctcaacaagtaagtataatccaaatactccaaaatccaaaaaatctgagacacttctggccccaagcatttcagataacctgtataactttcccagggtcacgtcattaggttcaaggtcacagagctagtaaatatgtattgagccaggattagaattcagctctgtctggcattacagcctgagcttttaaccagtatgatcttttttaaaggtttcttaccaagaggttgtgttatttgttttgaaagatgaaataaccccatggttttttttcttctttcttttatttttttattttgacatggggtctcactgtgttgcccagcttggagtgtagtggcacgatcttggttcactgcagcctccgactcctgggttcaagcaatccacccatctcagcctcccgagtaactgggactacaggtgtgcaccaccatactcagcagattttttatatttttggtagagacagggttgtgccatgttgctcaggctggtcttgaactcctgagctcaagcaatttgtccacctcagcctcccaaagctgggattacaggtgtgagccaccatgcccacccccccattgtttttctaacagactcttttagaaaggagatgtagcatgttggttaagagtgtaggctccatgacctcatcttaaagtggcaatcataatagcacttgtttccttgtgtgattatgaacattacataatacatgtatacggatgatagcagtgtctgtcacattacattattattatctttcttattagtcattttgagttgaggtgtagtaggaacttagacaaaaggaagaccctagctttgtggaacgtctgattcctcctctgcaaaatggtgatgatgcctgccctgcccacttcattagatccagagataaataatgtataagaaaacactttagccaggtgctgtggttcactcctgtagtaccagcactttggggttctgaggcaagaggatcacttgaggctaggagttcaagactagcctgagcaacatagcaagaccccatctctaaaaccataaaatacggtagccgggcgtggtagtgtgctcctgtagtcccagctgctcaggaggatcacttgagcccaggtgttcgaggctgcagtgatctgtgatggtgccactgtcctccatcctggttgccagagtgagaccctgtctcccaaaggaaaaaaaaaaaattagtactcagttctctcgacacagatttttacaaatgttatctaaaaggcctttacttcttagtatgtataatttgggattatttattgatcagtgataggttgtgttttttaaaactttatataaaaagatttagaaaatccatgaatgtgccctttacattttcttgcaggatgaaactgtaacaattgaaacagtctttccatttgatgttgcggttaaatttgtttctaccaaggtatgtttctttgaggcatactagaaatcatttaggttataaaaatggactgaaatgataaaatggattaaggtaattcctgacagaccttttatcttcatttgtgacagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatggtgagtctggttcattcccacttaaagaccaggagaattgtgcgcgcgtgtgtgtgtgtgtgtataagctggcaatggaagagttaattagctttttgctaagtgagggaacttgagacctgcactcgtgaaagcaaatgcatatggaattaaggtggaattagtgtcatttataataccatttgcttgagtatacctgattttaaaaggttagacttttttcctactctaagggagttatactttgaaaatgtacttcacaaaaagaatttttttttcatttttgaactttttaaagatttttttctcattaactcttaatgtttactgtttttcataacttgaaatgagaaaaggtatttattaaagaaactttggaaaatatagaaaaatagaagttacattttctgagtcaccctactaaaacaatttgtaagactgattcaaatccaggacaacacctttctggttttaaaaagtactaataatatcttttgctttcagaatgtcttcatgagttttttttcatctctccttgaaactcggttttctcttgtgtgtttggaaatcattgtctctgtcctactttgtttttctgtctccttccctttttccttattgtccttattgtgctaattgggaataatgagctttagggtcagactgaactagattcagttctcagccctacaacttgttctttcatgaacttggatggttcctttcatcacttcttagagtcaaagaggatgatgtatgtgaaataattaatatatatgagaacatatgaaatagctcagtgctcattttctaacagctcaataaaagcttgttatttgtccattcttgctgattccttttctttcagtgttggtcatttccagtatcctgacgttggttctcttgttctttctctacaagtcttcagctgccacacgaccttaggctgcctgcattccctcgtccagttggaggggttgtctggttgtaagggttgttgtacgtacacttgatccaagctggaaactgcagagaaaaactacactccttcacacgcacatctatccttcacacccacatccaaacatttttttaatccagcttttcatctccatcctcagtgccatcctcaccatttctctcacctggtctatagaagtaggtccttaactgttttcttccttggcagtcattctcttccctatcctgcctttcatattgccactagactttgtgacacactggacctcacctggtcaggctctggctgaccttcccagctgcctctaccccaggctgtctactgccctttgctctctcccaggtttcaaccaagacaaacttagggcattcatccaacattgcccccagctacttttgaacatatctttggaacttttgtgtaaaaccttcatctttttcaacctgttgaactctggcttgctcttcagggctcttgtaaacttgaacttcttgttcctcccaagcaggactaagtactcttccttctttattcccatggtgttttgtacacacctacattgtaacacttaccatattatattgcaatttcgtatttgtaaatatggctcccttactagactgtgtgttcccttagaacctgagttgtgtcttattcatcttcatatcgctagcatcatagtacttagctaataagtgtttactaaattaaggaataatctgtggcttgaacttctagtatattagtttcttactgctgctgtaacaaactaccacaaagttagtggcttaaaatgacacagattcaactgtattaaagttctacaggttagaagtccaaaaaacaaggtgtcagcctggttgcgttccttctggaggctctcagggaaaatctgtttctttgccttctccagcttctagaggtcacctgcactcctcctcatgtggctccttcctctgtcttcaaaaccagcaggtagcacttctttgtcacaaattgaccctaatgttaattggtttttttttttttgagacagagtctctgtcacccaggctggagtgcagtggcacgatctcggcttactgcaagctctgcctcccgggttcatgccattctcctgcctcagcctctccgagtagctgggactacaggcacccaccaccacgcccggctaatttttgtatttttagtagagacagggtttcaccgtggtctcgatctcctgaccgcgtgatctgctcatctcagcctcccaaagtgctgggattacaagcgtgagccaccacgcccagccaatgttaattattaataaacattgtgaccgttttatttaacttcttacaattaaggagaactttggtagagtttaatatgaatggcccaggttttttaaaagacgatctctagaggctcaaactgatgtgtattttatttactgggctacaatatcatttccaagtctttaacattacataaaaatacttaattaaagcaaaggttgatccagcttttttccctttcactgttgttatctgtccacaatcagacctccattgatctgtcacaaccatcttcattagaaaaccataaaaatagcctaatgtttagaaactttgttgttattcctttggagttgcactcacagattgctaaaattgccgttaaatatgtactgttgcctgcttgcatttgaagctgaggcattgcaggctctggagagctgaaaggtggaggagacttggtttgaatgggcgcttatcttgtcatcagggaatttgctataaaattggcagaaggaaagcattcttgcacagaggtgaatggccatgtgaggcaatagtgaggcggtatgagtgctattagtaatacaggctgagtatctcttacctgaagtgtttggtactagaagtgtttcagatttcgggtttttcagattttggaatatttgcattatacttagtgggtgagcatccctcatctaaaaatctgaaatctgaaatgctttaaagaacatttcctcttttaaaaaaaaatttattttcattttggagccaaggtctcactctgtcacccaggctggagtgcagtggcaggatcatggctcactgcagcctcagacttctgggctcaagctattctcccacctcagcctcccaagtagctaggaccacaggtgcacgccaccacacctggctaatttttaaattatttatagggacgagatctccctgtgttgctcaggcgagtctcaaactcctggagctcaagcagtcctcccaccttggcctccgtaagtgagattacaggtgtgagccaccacacctggatgcacttccttttagaataacctttgcgtgtcatgttggcactcaaaacatttcagattttgaagcattttggtttcagatttttagattagggatggtcaacctgtatatgtttactcagagaaagccacaattttctggaatgatattttgagtactttaagagtaactgaaattttctattttctttttctctaccccaaagtgtttactttggaggcatgaaataatttggaaaaagaaaaacaatcaccgtaagatattgattctgtctctaagctttttgcattcattagtttccataggactttcttgcagatatacagatgcctcattggattttactgtgatggaatattggtacattagcaaaaacagtggactttgtgaccttgaaaaagtcatttaacatctctgaaccctactttctaagtctctacaagtaatatatagtgggtgaggtgttctttctttgttctgttacttggatgtgaaactctccttttgtagatgaaaccattgcataaggaatataaagacttttccctgtagttatcttacagactggagagagtgctagtgaatgcttttgtcttcaatgcccatctcttggaaatattgaaggtggagtagcaaccgggcattatattatctcttggaaaaggtaagaattatgtcaatcctgtcttttcttcaatgtctctgttattctcatacctttattattcatctttgtcacttaatatttgagagtttctgtcattctgaagagcagaagtcatgtggatatgaacacaaacctgaaaaagataattaaagctgaatttgtgcttgtcgtaatttgtgacttatatgctattaaaattttagccaaactaaatctgtacacaaagggtgtatgtataagaatgttcatgggctgggcgcagtggctcccacctgtaatcccagcactttcgtagacctaggtgggaggatcgctggagctcaggagtttgagaccagcctgggcaacatggtgaaaccctgtctctacaaaaaatacaaaaattagcttggcttgttgatgcacatctgcagtcccagctactcaggaggctgaggggggaggatgacttgagctcaaaaagtggaggtttcagtgagctgagattgtgccactgcactctagcctgggcaacagagcgagaccctgtttaaaaaaaaaaaaaaaaagttcatagcagcattgattgcaataggaaaaaaatgggggaaaaaaacgtaaatgcccatcaatagaaaagagaataaattgtggcacgttcatacagtggaatactatatttcagtgaaatgaatgaaccagagctacaccatcaacatcttaaggtaaagtgaacaaagcaagctactgatgagaatatgaataaattgcatttatatgccattgaaaaacatgctatgtatttcttaggactacgtacataatttggaaaagtataaaatacataggaatgataaatacccaattcaggatagtggttacctttgggatggggggatacaagcaggaagggctctgcaggaagattcaattgtatcattgtaatttctttcttagactgggaagtagatacatgatattcatgtgttatcctgttgatgaggcttagttattttcagaaattttaaaacagggaataaaatgtattacttaaaaatgagaaaggaatcagaagatactagttttaagggaatgtttatacaactcagagtaatgagtaggaagatctgaatgttatggctgtcatgaaaaagttataaattatcaaaattgactaaaggaaaaattttttaacctaaaaaaaccagtaactggaggaaattcatgaaattgccttcaaagaatatatgtttagtatatgtaattacatggtatgacttattgttttcatgttataaattatatgcaaagcatagaacaagaaggaaaatcccctgggtttgttcatgaagagcacccatacctaaacctgacaaaggcagaaaataaaaaagacaactgtaggccagcagttctcaaactttttggtctcaagactcctttacactttgaaaaatcagtgagaaccctaaacagcttatttatgtgagttatatgcataaatatttaccatgttggaaactaaagcagaaactttttaagaatggagaaatatgtaattttactaagaagtaaataaacttgtctttcttttccccattcctgaatttaccatattgatgtttagttttatttttttgtttgtaggtgtcaaaatagcattttaaaggcactgctgaattattccatcatactacagtatgaatttgtgcttgtcataatttgtgacttatatgctattgaaattttagccaaactaaatctgtacacaaagggtgtgtgtataagaatgttcatgggctgggcacagtggctcacacctgtaatcccagcactttcatagacctaggtgggaggatcgctggagctcaggaggtatattcatttcttattgatgagggcttagatgctttgcctgttgcttttgctctgtgatagtttgcacatcatgtcagctgctccacccttaggctcaaaagggatttccctggcaccacccttatagttcccactttagctgtaccacagggaaaatatttaacagtttcataatgttacttcagctccataaatattggaacaccactatgtttgttgatagtaaaatacttttagttcttcagtttctactgtatacgtgtagtgagttacaatagtgctcttcaaagtggtctggggcccacctgtaaaccatcctcagtgagttaaggaatttatgtcatgatgtaaatcactgcactgttcctgaattgagaaagtcttgctaccaaaacactgtattaaatcgtgtgcatcatgattgacagtctgacacacctcctcacttatcccccactggtaacatgcagcagccctgggttataacagtttgttaattggaaatactcagaagtgtgattttaaaagctcttaacttcacaaaatatttccattaataatgttttgggaggcctggtgcggtggctcacgcctgtaatcccagcactttgggaagctgaggcaggtggatcacctgaggtcaggagtttgagaccagcctggccaacatggcagaacctcgtctctgctaaaaatacaaaaattagctgggcgtggcttcacgcgcctgtaatcccagctactcgggaggctgaggcaggagaatcacttgaacccaggaggtggaggttgcagtgagccaaggttgcaccattgcagcccagcctgggtgagagagtgagactgtctcaaaaaaaaaaaaaaaaaaattggccaggcgcatgcctgtaatcccagcactttgagaggccgaggtgggcggatcacgaggtcaggagatcaagaccatcctagctaacacggtgaaaccccgtctctactaaaaatacaaaaaattagccaggcgtggtggcgggcgcctgtagttccagctactcgggaggctgaggcaggagaatggtgtaaacctgggaggcagagcttgcagtgagccgagatcgcgccactgcactccagtctgggcaacagagtgagactctgtctcaaaaaaataataataaaataataataataatattttgggaaatggataagtaacatttcctttgaaactagctggtgaatacatgtttcctgtttttgatgaacttctttcatagtttaaaaagatgtttaaaaagagtttaaaaagatgacctcttctgccacaggacctcagcaatggagaatatccccatcatcacaactgtcatcactctgccgcacgtgattgtggagaatatccctctccatgtgaatgcaggtagcggaattcaaattttacttgataagaaggacccaataataatagttattttaacctctaagagtttagttattttaacattctatttagaaagtttttcagcatttgtaaaagtagcttatggccagtcttgcttcctctctacttctacacactcctcctacccctgttattttggaacaaatccctagatacaaagccataaatactttcatatgcctgttttaaaaataatggctattttaaaaaatataattacagtaccattatcacctctttaaaaattagcagtaatgtcttaatgtcatcaaattccaatgttgaaattttcctagttaactctggatgttttttcagtttattttgaggactatacactgcaactgatggataagtcttatactatcctgtaacctataggtaggcagctaggctgactactactccctcccccataccatctctcctctccccacccaccattaacccctgcatcacctcttccaataccgctttctctaccactttgtccatctcctccctccccgcatctcttccttgctgaagaaactaagtcatttgtcctatagagtttcccacaacctggattttggagattacatggtgctgtttttaaatgtttctctgtccctataaattggcagcctgtctgtaggcttgatcagattcagggtcaagtttttggcaagaatacttcatagtgtatgtgctcccaccaggaggcaggtaacatctgtccatcattctttctttactgaaatactttatcaagagaaacttccctttatcaactgtttggttatcctaatgtctataatttgaaaaaactgtttatagtgctcacttcaacagcatacatgtaaatgggactggtgcagagatgagcacggccctatgcaaggatgacacccaaattcatgaagccttccatgtttttgtatcctaggaaaaataaaatggcagaactgccagaacacacacacacacacacacacacacacacacccaccaaacaacagtgtatccacaaatgaatgaatgaaagttttacttataacttcactgaaacacagcttttgcttattctagtttaggaaccatgagtgatattttgggaaaccttttatggatttaagaaatgatccctggctgggcgcggtggctcacgcctgtaatcccagcactttgggaggccaaggtgggtggatcacgaggtcaggagatcgagaccatcctggctaacacggtgaaaccccgtctctattaaaaatgcaaaaaattagccagacatggtggcgggcacctgtagtcccagctacttgggaggctgaagcaggacaatggcgtgaacccgggaggcggagcttgcagtgagccgagatagcaccactgcactccagcctgggtgaaagagcgagactccgcctcaaaaaaaaaaaaaaagaaatgatccttaaaatataattcagttcctgatagccaagaccctgtctaggccagtcatttttagaaggacactcatttccttagcctgttttatcatagtcttattgctgttgtccaatcaaagaattttcttatccggcaagagtacagtaacgtcattaatttaaatgatactatgtccacagaatgagattcatttacaaaacgaagccataagtggggagctattttttaaaccaagagaagtgtgtcatctttctctgtagatctgccgtcatttgggcgtgtcagagagtcgttacctgtcaagtatcacctacagaataagaccgacttagttcaagatgtagaaatttctgtggagcccagtgatgccttcatgttctcaggtctcaaacaggtacaggtcatatcttgtgatgcttatgttgacacaaaagtgtgccaggaaacggagagctgtacctttagtttttatgaatgaactgagtaaagctgactgtggtccctgttgttttggtaatagtgaatttttaagcaccttaagtacagctgcctataaaggtgggttacccttgtcacatcattgagacgagacacgtgggttcttcttataaaacagaagtccacaaatccttggactatattataatatgttataattcctgaaaaacttaaaaatgtccccttattactgatgagtgtgtgtgtttatgtgtgtgtgtgtgtgtgtgtgtgtgtgaggcctggagacttcactgtcctaatattaacagcccatttttctatcagtgaagtttcatagcaattttgattttgcgtagaatatacttaacctttcgtgtgtttagatacattttgtttctatactttaaattatctagatttttttatttgttcagtcaaatcaggttggaaaagttcatcaagtttttaaatgagcaaacaaaatacccaggcaaaaccatgcttcagtgagagtcctgtcctccactgtcagagggataacagagatgaccctccaaagtcaggaaatactttttaattaacaagggcataattagagaacatatgtgtcttaacacctggaagtgtctatcctgactaattaactgctctgcatattctgagtgctgtgtttgttgttaaatgcaaaatagaattttatatgaaatatgctgtatgttcaggtactgttttatatttataatatacagtattaaatataccaactatagtatttacaaatgagtgagcttttttcttgagtgtcttgattttttccacgtgttgacttacataaatcgtaggaaatataaagatgctaaaatcttaccagttagtatactttttaaaagtattgtcaaagattttcaaaacatcttttttttttcctcctgcagttacttaacacaaaggtaaaatccttaaaacaaaacaaactactaaataaattagaaagaactaatttggtattgacataatgtctacaagtagatactctttttacaaattatccctttacatattgtgaacataaaagctacctgggctaaggcagagaaaagattcacctgccttgagttctcattctttaggaggtataagttacccattgtaggtcttggtagaaaccgagaaatcttgcatatattttttacacatttcctgtctgccatgtcctaaactcatactaattcagccctacactttggaatctgtttggaagatggactaggagagagtgaatatttcagtagaaggatttggttatccaatcttttgtaaataattgagggtaacaacatatagatattgcacatatgtgtatttgattatctttctctgtgactttttatgatgcagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaaggtaaagcttagcaattttctgctttttaaattcaaagtcttaaaaacaaacagacttctttttcatgtaaacttcactgaacagtattttgagaccaacagtgatagttttgccttttattatatgtatttggcagtattgctgttcatttctatagttactttttatagaatctaatttcaaagattgtatttccttaggtaaataatgatttatctttataatatccttaagcatattttctctttggtttagtaaagtatgctttaaaattgtaatttgtttgtaactagtatttcatcaaaatgaattaactttaaatatccttaaacttttctgattccctgtaactgtgtaatattagatttagctctcttctgaaaatgatcatctctcagaaactatactctgatttaatgttttttttttaattacacaatttccaggtccctacaataaaagaatacatacgatgggcagtgtgtaagagtgaattggagggatgagtggttaatttagctcagcagcccacctctgattgtcactccctgatacctaaataagagccatctctccacatgcttctggtgtccctctaacatacatatacattaacataacatacatacacattaatatatgtcactgctgtgcgccctcttttaagtttctaccctcatttggaatgacagtttatattgctcactacttccttttttgtgtctgtcttattcaagtttgggggaacagttccttgtttatataatccaggatttggtaagttatctgttaataatattctctgtactctgccagcttttatatttccagacttttatacagagttttttctatctgtataaaaataattaaccctcccaagctcctattccacaccatacttttaaattgtaaaagaggcctggcgcagtggctcacacctgtaatcccagcactttgggaggccgaggcgggcagatcataaggtcaggagatcgagaccatcctggctaacatggtgaaaccccatctctactaaaaatacagaaaattagccgggcgtggtggcaggcacctgtagttccagctacttgggaggctgaggcaggagaattgcttgaacccaggaggcagagcttgcagtgagtggaggttgtgccactgcactccagcctgggcaacagagcgagacactgtctcaaaataaataaataacttgtaaaagaaaaatctcataattttggatatccttgtgtttaaacgctttttaaatattttcgccagatcccttcagtctaaagacatttccattggccccacactctcctggtgaagtcactctgcaggggacgagtctcatgactgggtgggggaacagaggggaacaggtggcctccataatgtccctttagctgttagactttttgaagtttgctatttttaaacttagaagtactgtttgaatcatttagatgtatgtagacttgatcatattctagctgcacagaaatagcttgtttgaaatactagagtaactaatactgaaaaggagagatttttggttccatcaattattctctttcattcctttctctggtgctcaggagacccaaacctaatcccagctaatgcttgttcagtcttttgattttctctcaaggtaaacctcttctgggtagtgtttaaattcacaaggaaaggttccagaaaataaacttttttttttttttgagacagcgtcttgctctgttgcccaggctggagtgcagtggcccgatgtctgctcactgcaagctctgcctcctgggttcacgccattctcctgcctcagcctcccgagtagctgggactacaagcgcctgccaccacgcctggctaattttttgtatttttagtagatacggggtttcaccatgttagccaggatggtctcgatctcctgacctcgtgatcctcccgcctcggcctcctaaagtgctgggattacaggtgtgagccactgcgcccggcctaacatttttaacatgactagcatgccctgtttaactgcagggatccttttctgagtacagataccactttctagcaacttgactgctgccaaaaatgttcaccggactccgcagagccagctctttaatcagtagggaaaatttataattaaaaaattttggccgggcgtggtggctcacgcctgtaatcccagcactttgggaggccaaggctggtggatcacctgaggtcaggagttcgagaccagcctagttaacatggtgaaaccccatctctagtaaaaacacaaaaattagccgggtgtggtgtggtgggcgcctgcaatcccagctacttgggaggccgaggcaggagaattgcttgaatctggaagacagaggttgcagtgaggtgagaccatgccattgcactccagcctgggcaacagaatgagatgctgtctcaaaaaaaaaaaattgccattctacagtgtatatatagtgtacatatttcaaaacatcatgttgtataccgtaaatgtctacaatttttttttttacttgtcactctaaggacagtggctgaggattaccctttcccacttattggacaatcactgactaaaattttaggtcctagtgcacctgtattaaactttagagctatgctgtccggtatagccactagccacatgtgactattgagattcagtttaaattaaatttgcttagttacactgccacatttcaagtgctcaatcgctaaatgtgactagcgactgccataccagacagtgacgtcctaggcaaggatgaatccatacttttcttcctttgaataaaaggctttggttttctaattgtatgatgcactcattttttgctcttgcttgtaaaagctacatttggcagggatttcactagcttgagccatgattttgtttctaaaattgagcagctcccatcagtactaaaaaaacagtcaagaatcaaggatcgggaacctatttcactcactccattcctgccgtgaatgtctggaagctatacttagctatgtttctgtatgtatgtacacacacactgctatatacatctgaacaaccacagcagcagcaaactgaaagcaggagtgctgtcttcactgcctcgggaatgcctcagaatctttctgcttaaagcatagcaaatcacttttgattgtgaacactcttctgtttcatttcctgatcatctttctcctgctttccccacaaaggtctgctattgtatatctgtataataaaataaaattatttgtaagaattgtattcttttagctactagctatccctctgggatgttgttaacctgccagaaattttacaactaaaaacagttacgataccttttattcattcttagtcttgacttttctgacgtgatgttttaaattctttcaatcagtgatcttagagatagggcagtttttgtttttatctgccacttttatccttgcagcatgcattggagttcactgcagacactttttctcaaacaggagattgggcaaccttgagtccccaaaaggaacttacctgtcagctcaggctctggacctgcttaaagcttgagacacaggagggccctgagcaagagagagagaataaaactatcagttaagtaggaatgataaacaaggttccattccacatgtgggagatggcctggcagtagctgctggaacgcagggttgagagagaagtactgacagaagaggattcttcgggtggaagtgcagagtcagctggtgatggctacaggagagggcagctcccagcctgtgccgtggccatccccaggtgcaagtgaagaaagaaagaggtggggtgaaaggaggagaatcaccatatcaccatttttattttgatgcttacactcatttattctgtttttgtaaaacagtttcaagaatttaaaaatccttccagttaatagagcttttgttattatattataattttgtaaacccactttgtttttcccactttaaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtatgcttgtctgtctctatcttttattttgagcttgtttgatttcagcttcatggaacagcttttactaagaacactgttgcatgagatgcaatggcaagcacaggattgaaaattgggctgtgttctagaactggctctggtaacattatgtgagagttggacagtgctatcttgggaggacatgagctccctgttgtaacatggcttttcaggtagaggccatggagcatgactctagagtccagctgtctaggatcaaatccctcctctgctgcttttgtctgggtgacgttgttcaagttccttaccctctgtgtatctcagcgttcttgtatataagatgtaaataacacccatcttataggcttgttatgaaggatgatatagattcatacatgagaagagcttggaacagtgccagacccaaagttatgtatgagggtgctcagccagtgtcatctatatttttatgggaaggctgaagagggtattcacttttctactggagagttccatgttatcagaatttgttgatacattttacataatttactacatatatgagtatacatgtgtatgtaaatacgtgaaactataaacaagtttcatagaagaatgcattctgtgtactcttacatattttgtatcctactctgttttgttaaaaaacatccctggttataaacctgatgaattgatttcatgacccactaataggatgtaaagtgcggtttgaaaaatactggaccaagatcttgaaggtgctgttgaattctaagatggtctgacgcagtgcttacataataaagatcccatgtgttaacactgccattgtcaaacgaagtacatgtttgaacagtgggtcactgacatgcactttaaaatgatcaacatggatggcagtgggatttgtgtacctgtgcgcgcttctgtacggatatcaaacaggtctttttcttcttgatctttcttagagttggcaatagagtaagcctttctcaaccaggaattctcccatatcacaaattctactgtgagtatattctgtctacctattttgaaactgaaaattttgattcaacaatacatgaagtcatcatctaccctgggttctaaactcagaactgttacagtgttgcaggagctcttcattcactgaggctccgagtgtcagggaggacctcaccctctttctccctgcctctgccagcagccacgaccatctgtccctcatgagaacgtctgccttctgtctttgtacgtttggttctcaacattgctgtctgccagtgttcgcaccatccagggatacagttttttaaataaagtgttataaattgtgggggaggtgtgtataaaagtttaactcgtatacatgatgcgataagcactggtggataatccaaatattaccaaaaggagcatgcagatggtaatgtctttgggaaggacaaagttattaatttgcttagttttatatctttgtgatccttcaacttgcaaatttgatcccttcaactcagttttcctcataatgtctttagttctctatctttgaattcttatgagaatgaagaggttttacagagcatggctcttcacgtttttcagaatgtcttcacattacttggagattcattatttttgttcgaattcagtcatttctttcatggaccatgttatatttccacccagaatataaaaagccccccagttgatactctgaaataatagctgtgaagaattccaagctgtaatttccatgttggtgttgtaaggagaaagggagcgctgttaaggaaaggacagcaagcagacaagcgaagttcgccttttaatggggagggtccctgccgccccagcaaatacccttctgaagcctcctcacctggccttaaaattcagaaaaggcacccaaagtgtcccaactcagtttaaaagttagacatgggttgcattatttaatggtagagtggataaatagcagtgacagtaactttcaaagcagttacgtgcatgcagcattagtaattagagatggtccaacaaatgtgtgataaccaaatagaaatgtatacattatctcatctcctcagtttttcatgccatatggattcaccccacaggactaaatcttctctagctaaagcattatgagtgaatgctaactaaaagcattcagttatataaggaaacaaatttttacgttattttattgtcccagtattcttacataccctgttttacaattacagatttgttctgaaacatttctaatgagtgacactgctgctgttctttttttttttttttttttttttttttttttgagacagagtctcactctgctcattctgttgcccaggctggagcgcagtggcatgatctcaggtcactgcaacatccgcctcccagtttcaagcaattctcctgcctcggcctccctagtagctgggattagaggtgtccaccaccatacccagctaatttttgtatttttagtagagatggcgttttgccatgttggccaggctggtctcaaactcccgacctcaggtgatccacccacctcagcctcccaaagtgctaggattataggcatgagccaccgtgcccggccatactcatgccattctttggtgaccataaccataccatttattttagcaagtgatgccattctcagacatacctactgaagagctccataaaattcactaaatgagtataaaattccatgtttttcatgaaaaaaaatgcatagttccattatattcaagttttccttaaagatcaaattggtgaaaaaacattcccttccactcgatttacttatgtctgcaaaaggagaagacgatcacaaggccttattgtttctgctttctgaagcatgttttactagaggggaaagtagaaccaaggtcaaaactgccacgcatgtccactcagggtgcactgcctgagttagccctgctttgcagggagctgtgttaaaagggaaaaatctcaaactgccgagtacccttgcatttcaaggtctgtgtaccatccaagttatactccaagcaacttttttttctttttttactatgctcactccagtttttttttttatcatttctattttctctccattgaaagaacacaaaactcatagtaaccttgaaattggttttttatttacagaatacacccttatccaaaatgtatcaacatgaggcagagcgcggtggctcatgcctgtaatcccagcactttgggaggctgaggtgggcgggtcatttgagcccaggagttcaagacaagcctgggcaacatggcaaatccccgtctctactaaaaatacaaaaaattagccggacgtggtggctcgtgcctctagtcctgtagtctcagctactcggggagcttaggtgggaggatcactcgaacctgggaagtcaaggctgtagtgagccatgatcacaccaccacactccagcccgggtgacagagcgagatcccgtttcaggaaaaaaaaatagtatcatcatgcatggtaaatggaaacttacaaatattaccttgttaggttggtcaggatttctaaactatctttcccaaatgatcattgctaacatttattgagtaatgtgatgtgccacatgggtatgtttttatctcatataatactcataaaagctcaatgtggttttaggtactcttattattcccattttgaagatgtgaaagctgaggcgcagaaaggttaagtaacttgcccagtgttctggttatccattgctacaaaacaaatctgcccaatgtttaatagcttaaaacaaccatcattatctttatggtttcagtggggcaggaatttgggaacaactcagatggacagttctggcttggggtcactcatgcagttgtagtcaaacagtagctggagttagaataggaccaactgtgagaaccaggggaaccgaggcagcttggagctagccaggcacctctatttagttagggtcgctctatgtgttcactgggattcctcacagcatggccggctgaaggtggctggactgcttacctggcagctcaaacctccagtgagaatggaaccagcaagggaagctgcatcaccttttttgaccttgccttcaataacacataatgtcactgctagggtcacagtccacccagattcaaggggagggaacacaaactataaatgtcacctcttgagggggaaatggcctcatccagaaggtacaggacaggaggtattattgcctccatctttggaaaacaaaatctgctgtacccagtgacatggcaagtgggagtagagctgggactgtcatcaaggtactgtcctgcagaggccgcaacactacacagccaccattctaatgctgccagggcttagtcctaaataaatttgtcttgagctaaattatgtatgcctgaagtactaggcatttttatgaattaagatctttccatgcctgggtctccatggctgaagcctctaatcccaaaattttgggagtctgagaggtaaggatcgcttgaggctaggagtttgagaccagcctgggctagcaagcccctgtctccacacaaaacagaaaaattagccaggagtggtggtgcccccctgctactctggaggctgaggcaggaggatcacttgaacccaggacgtggggccgcagtgagtcatgattgcaccactgcactccagcctgggcgacagagagcctgtctctaaaaaaaaaaaaaaaaaaaaaaaaaattctttcattctgtgacagtaaatctattgccctcaattacacaaatttattccaagtatttactgtgggcctactgtgggccagtttgtgggctggttgctgtggccataaaggaatccctattcctgaagaccagtggtccagcaggagacactgccacggcagcaggttctgacacagtgtggtcagtgccatggaaatgggcacaagactagtaagtgatgggatgtctgggatttcctttaacatacctgaaaagaaacaaaataaccagattggagagaaatggatgaaacaagatttgaaaaatgttgataacattaaagatgggtgggcctgggggctttgccattcactctccttttgggtatgtctggaaatttccataataaaaaaataacaaaggatacaaggtagacaggagccccagggaaggattaactttattatagagtatgaggaggaagctgcggggaggtagggcttcctcaaggagggacattgacattggagttgtttttgtttttgtgttcataataaaatgattctgtgcttttgttgtgtgggaatgcatttccatcatccatgaacagataatgttatgtgaactggattttggaggacatagaaacgtttgtaaaataaacagatcaaggaagagctttccaggtgatgaaagggactgttggcatgcacccctgcggcaccctggcatgccagtgctttgaacatagacagacttgtccactgttgagtaaacctaacctttatttttttcttccttagatattcagtgataagagaatggtgagcaggggatgaaactcacttaaaaatgcaagcgcgcttgctgctgtctccctgcacctctgcagagcagggcttctctcccggagcttttggaggaagctggtcttctttttggtaatgctcatcagcttgaagaaccgtagtctgaaaaaatatttgatcttggagaataattcaaaatcactatctcaacaaaggactgaattccaaatgccaaatttaacaggaacagttcataaaccctttattcaagatgaaataggccaggcgcggtggctcaggcctgtaatcccagcactttgggaggccgaggtgggcggatcacgaggtcaggagatcgagaccatcctggctaacacggtgaaaccccgtctctactaaaaatacaacaaattacccgggtgtggtggcgggtgcctgtagtcccagctactggagaggctgaagcaggagcatggcctgaacccgggaggcggagcttgcagtgagccaagatcatgccactgcactccagcctgggagacagagtgagactccgtctcaaaaaaaaaaaaaaaaaaagatgaaatacggaattattcagtcataggatgggaggggctccgtaatagctttttaaaatcaaacagctgatttttttttaatcaaaggtattagtgacaccatttggtcagactacatttacgatattctctccacttctgattgccatcctttatttcattttacttttttattgtgaccatttccgaacagacacaaaagtagagactgttacacacttccatgcttatactcagcttcagccattaatgccttgccctctaccatccatcctccctacctcatttcaccagaaagaaaaggacttttaaaatcacacaaccacaatgcattattacatctaatcaattatttctttacattgtctagtataacatattcaattttccctaagtctttttacagttggcttgtttgaatatggatccaaacaaggtccatcattatattgtttcatttcatgtagaacagtcccgtccccctttatatcccctattgacttgatgaagaaatgggtcagttgttttgtaaaatatcccacattcggggtttagttaattgcaaccccagggtgtttatgtaacttgttcctctatctactgtttttccaatggactgggagttagagttacaagctagcctgagctcaaattctttctccttctcatcctccctccagttcttctctcctctacttccttcctttcaccctccttctctctccctcactccttccttccatctttcctttttttttttttttttcagaataaggctatttcataggtgatatttcccatcaccacacttctgtctcgtctcgcttttcgtggtaagactgatcaatgggtttagaggatggcagcctaattcctttatcataaggttcagctaaacagccatcgatgcaattgtctgaattgaatgacgctcattgcattgacgcattgatcgctgtttagctgaactgtatatttaacttaaatgttttaaaattagaagtttttcaattggaagttgcaaaatgtaattaaagaatgctattctgcattcattgactggaattcttagagaattttttttcctcatccactaggtctatttaattaccctacaatatagttcctacagcaaagagaactttttttcttaattcagcccatcagacaaggaagcaaagataatttttaataacctaattccttctctttatttgtaattttcttccttttttttttttttttttgagacgagcctaactctgtcacccagatgggagtgcagtggcatgattttggctcgctgcaacccccgcctcccgggttcaagtgattctcctgcctcagcctcccaagagtagctgggattacaggcgcgcaccaccaagccccgctaatctttgtatttttagtagagacggggtttcaccaggatggccaggctggtctcgaacccctgggctctagtgatctgcccgcctcagcctccgaaagtgctgagattacaggagtgagccccagcggccggcctctgtatttttaattttcagtgtaacgagttggtggccctcctatctctaatgttatcccagagcttcggtgtttgtgcttcgtgccctctccgtttctcccctgttcttatggaataatgatgtgcattaggagcctggggtcaggagtccaaggttagggtgagggctttcccgtggtgttggcagcagctggcgcctgcgccctccgtgcaggagagcagctccctccagcggcttccctcgcgctttgtgccttgcccaccgctcagacgctctgctctgaaaagtaaagttcacaaggtatcttcagctgcaaggataaaatcaagaagacaacttcaaacacaacctttatcaacttaaaatcaatattaatgtacgaatggtccgaatggtcaccttgggaaatcagtgaaagggcctgacatggagaagagattaaattatgtttaataaatgttcattttatgttcattctttgaaaacgggcactcattgagtgacagatcttttaccacacacaaacactaacagatacgcgtaactgcgccctgcgacattttattttccggctgctccccctccgctgtcaggtgggcagtgtccacggtgcttaggggaacaggaggggttccggtgctgcttcccttccgtgcacagaaaatccacccaggctggcgcggcggctcacgcctgtaatcccagcactttgagtggctgaggggggcggttcacttgaggtcatgagttcgagaccagactggccaacacggtgaaaccgtctctactaaaaataaaaaccgtctctgctaaaaaaattagccaggctaggtggcgcgcctgtaatcccagcactctgagaggacaaggcgggtgggtcacctgaggtcaggagttccagaccagcctggccaacaaggtgaaaccgcatctctactaaaaatacaaaaattaggccgggcgcggtggctcacgcctgtaatcccagcactttgggaggccgaggcgggcggatcacgaggtcataagatcaaaccatcctggctaacacggtgaaaccccgtctctactaaaaatacaaaaaaattagccgggcgtggtgcgggcgcctgtagtcccagctactcgggaggctgaggcaggagaatggcgtgaacccgggaggcggagcttgcagtgagccgagatcccgccactgcactccagcctgggggaaagagccagactccgtctcaaaaaaaaaaaataaaaaataaaaaattaaattagcctggcgtggtggcagacatctgtaatcccagctactggggaggctgaggtgcgagaatcatttgaacccgggaggcggaggttgcagtgagccgagatcgcgccactgcacttcaacctgggcgacagagggagacctcatctcaaaaaaaaaaaaaaaaaacaaaagaggaaacaaacaaacaaaaaacctacaccagcccagcctctctagcgaggctcacccgcccgcccggcccccgcacccggtctcggcttctctggccaggccgcggggccgttcggcgcggggcggggcgtcggggagtttccgcagcggttagaccggccaggggacctcgggacaatgagcctttctgttttaaagccggaacccagccgggccgcgccgcgaggaggctcccctgaggctggcaggagagacctgcagaaactcgtgcgcgccgagcgaggcgggcgccctggggctggggcacgcggccggcgggggccgccagggagcggccgtggcgggaccaggactacggtgcgccccgccgccgccagcacccgccttgggaagcccgtccgacgcgtacgctgcaggggccttcaataggggctgtcgccacctgcacccgcgccgctgcggttcgcaggaaactcctgtggcttttcggaagcacaatgcagaacgcccggtgagggtttgcaaagccgccctgggagatgccgcagtgtgaaacctttacggttgcacctggcctctctgctgcatctggcctgtctgctgcacctggcctctctgccccacctggcctctctgccccacctggcctctctgctgcatctggcctctgctgcgcctggcctgtctgctgcatctggcgcctgttgcacctggcctcttggctgcaactggcctctcagctgcgcctctttgttgcctctgcaaactcgggtgccctggagcttcctacccagaagtgagtgccgtgcacactgcaggtgcgaggtgcccctccttctgtctgttctgtttggtttggcagatgacagcactctcagtggggcctgaaaccttgacagtcatggctttctttgtaaggactctcttccttcattaaatcgcttgtatttggattacagagatctgtcataaagagattcagtacttaataataacgtggggaaaggatcaccaggtactgttaagaaaaaagcaaggacagaacagtgaatacggtaatgatcttgtttcgtaatacaaaacaaaacagacactatgcaaatacaaacccaaaggaaaatgatcatgcataaaaatactgtttttgggccgggggctgtggcccatgcctataatcccagcactttgggaggccaaggcaggaggatcacttgagtccaggagttcaagatcagcctcggcaacaaagcgtgacttcgtctctacaaaaattaaaaagaaattagccaggcgctggtgtgggcctgtagtctcggctacttgaaaggctgaggtatgaggattgctggagcccaggaggtcaaggctgcattgagctatgattgtgccactgcactctaggctgggcgacagagctgggccccatctctctctctctctagaaagatagtttttggattgttggattgtacaggtgataataattttctttattttacttatctgttccgaatagttttccacagtaaacatgtttttttttctaagaagaagggataataaatgtttattttttgaaaggaacatagatcggctgggcgtggtggctcacgcctgtaatcccagcactttgggaggcggaggcgggcagatcacgagatcagaagaccagcctggccaatgtggtgaaaccccgtcactactaaaaataaaaaaaaattagctaggcacggtggcacacacctgttgtcccagttactcgggaggctgaggcaggagaattacttgaaccgggaggcggaggttgcagtgagccgagatggtgccactgcactccagcctgggcaacagaatgagactccatctcaaaaaaataaatcaataaaaggaacatagatcacaacaccagagggaagagacccagcagacgggtcctatgcagaaacttgctccccagtgatccacaagtcacccaggaggtaaagtatatgcaagccacatcagtgttccaggatgagggttgccattaacaagtttgtttccagccctgaaatctgttcccatttgaacaaatattactcttaggaatagtatagggctcccccaccaagatggtttaagcaaaggtcataggccctgcctgtctaaaaatgtaaccctgaagttctttttgggtgaaagcattgttaggtgtctcagacaaggactgttctattcaacacggaagcacgcgtttgcttgtgagctgttactgcagacttgcctgagatgcatccagcccagaagggcaggcacagtgggcagcttgtgtatggagggagatcaaccgggagaagacacaaagatacatttttgagactttattatttcccatctaaaagtccacccctattctagtggccagaattgactgcagagaaggcagggtgcccaggaaggggactgtatggtaaacacagcattatcactgccacaggagcctggtagggctcagctgaaactccacctccctccacagccttcaggggtccttcttgtcctatggactcttctggcatttcctgtgtggatgcccatctcatacctttacatttttaaattttatttatttgagatggagtcttactctgtcaccaggctggagtgcagtggcactatctcagctcactgcaacttccacctcccaggttcaaacaattttcctgcttcagcttcctaagtagctaggattgcaggcgtccgccaccctgcccagctaatttttgtatttttagtagaggtggggtttcatcatgttggtcaggctggtctcgaactcctgaccacaggtgatctgccctccgtggcctcccaaagtgctggtgagaggtgaagccggctgggcttctgggatgggtggggacttggagaacttatttgtctagctaaaggattgtaaacgcaccaatcagcactctgtgtctagctaaaggtttgtaaatgcaccaatcagcactctgtcaaaaatggaccaatcagcactctgtaaaatggaccaatcagcactctgtaaaatggaccaatcagcttgctgtaaaatggaccaatcagcaggatgtgggtggggccaaataaggggataaaaagcaggccatgcgagccacctgtggcaacccacttgggttccctgcgatgttgtggaagggttgttgttttgctgtttccagtaaatgttggtgttgctcagtttttgggtccacactgtgtttatgagctgtaacacgcactgcaaaggtctgcagcttcactcctgaggtcagcgagaccatgaactcaccaacctgctgggagggatgaacaactccggacgcgccacgtttatgaactgtaacaccacgaaggtctgcagcttcgctcctgaggccagcacgaccatgaacccattagaaggaatgaacaactccagacgcgctgcccttaggagccgtaacactcactgtgaaggtaagcagtttcactccttaagtcagggagaccacgaacccaccagaaggaagaaactccagacacaccgaaggggtggcctgtccctccacacctgtggatatttctagttgggtgggacgagagagtgagaaaagaaatgacacaaagtatagaggaaacaacagtgggcccagagcaccagcaccagcactggtctctgagttccctcagtttctattgattactatcttcattatttcagtaaaaaggaatgtagtaggagggcagggtgataatgagaaggtcagcaacaaacgtgagcaatagaatctgtgtcataattaagttcgagggaaggtactatgactggacgtgcacgtaagccagatttatgtttctctccacccaaacatctcagtggagtaaagaataacaaggcagcactgctgcaagcatgtctcgcctcccaccatagggcggtttttctctgatctcagaattgaacaaatgtactatcgggttttataccgagacattcagttcccaggggcaggcaggagacctgggcagttccagaggcaggcaggatagtggccgccttctatctcaactgcaagaggctttccttttactaatccacctcagcacagacccttttcaggtgtcgggctgggggacggtcaggtctttctcatcccatgaggccatatttcagactatcacaaggggagaaaccttggacaataccctgctttcaagggcagaggtccctgcggctttcctcagtgcattgtgcccctggtttattgagactagagaatggcgatgacttttaccaagtatactgcttgtaaacattttgttaacaagggatgtcctgcacagccctagatcccttaaaccttgatttcatacaacacatgtttttgtgagctccaggttgggtcaaagtggctggggcaaagtggttggggcaaagctacaaattaacatctcagcaaagcaattgtttaaagtacaggtctttttcaaaatggagtctcttatgtctttcctttctatatagacacagtaacagtctgatctttcctttccctacaacacaccatctttaagaactataacactcaccacaagggcccatggcttcattcttgaagtcagcgagaccaagaacccaccaattctggacacactgggattacgggcatgagtcactgcacccagctcatcttgcacctttttaaaggctgcattctgtctctcaactagctctttgtcctgtatctcttttctctctagtgcccaaagcagggctcagatggggttggacgcagccatcaatggccaggggatgacttagttgctcgaaagtgcaatctgggctgtcttgttactaaaaacagttctgtgaaatgctacagtcaacagccacttgctggtttaactcagtgattgaactggatacagtgactagagagaatccaaatagtatggaggcccaaggtcagctgccttgttgagtcagtcagcagagagaaagctctccaccagagtacgcagaagtgtagcgggctatcttcagggaactatgtcctggatagctacaggatacggttttaggtgttctgtcaatgatcatattatttagtgcagttaaataaggatttattcactgatcaagcagaatttttaaaaatatatacttcccgaatgctaaaaatggaattaaaagcagccaattcttgtagaattgctgacttccctttctctatttgtgagagagatatggagtgatcccgaccttaacagaatttttttttctttgagatggagtctcactccatcacccaggctggaaggcagtggcgcgatctcggctcactgcaacctctgcctcctgggttcaagcgattctcccacctcgacctccccagtagctaggattacaggtgcccaccgccacacctagttgttttgtattttcagtagagaatggggtctcgccatgttggccaggctggtctcaaacttctgacctcaagtgatctggttgcatcagcctcccaaagtgctgggattataggcgtgagccattgtgcctggctaatttttttgtatctttagtagagacgttttcaccatgttggccaggctggtctggaattcttgacctcaagtgatccacctgcctcggcctctcaaaagtgctgggattacgggcatgagccaccgcgcccggcctagaccccggaccttaacagcagctgttaaggacacagcccccgtttggccaacgctaagcattttgccaaatagtagcttgttctgccttctgtgcaactctccgctggattctgttcagtcgaaggggatggcaggagtgaacgcctccgaactgtgtgtgtaaggagagggaggggctggcagacatcttgtgattgacagcaacccagtgtcagtccatccgtcattcattggtctctgaccccagcacaaatcccaccgaggctgttggaacctcggtagaggaagttggggtctcgcaccagaaacaaacgttccttacttacagaggggcagctttccctggaagttgaccgggtccggcatctgctcacatacgcctttccactgcctgggaagacagagtggcaaactggctgggcatttgtaaccatgtcatctggaatcctgtttgcatgtggatggagacttttcttactgtactctgaactgttcattcattctttgacttaacagatatttgtttgtttttgaggcagagtctggctctgttgccaggctggactgcagtggcacaatctctgctcactgtaacctctgcctcccaaattcaagtaattctcctgcctcagcctcctgattagctggggctgcaggtgcacgctgccacacctggttttttttttgtttttgtttttgtttttgtttgtattttagtagtgacagggtttcttgaactcctaagctcaggcaatccgcccgccgcggcctcccaaagtgcttggattacaggtgtgagccactgccccagccacttaacagatgtttattgaacactaaaaatgtgtcaggtgctctcttaagccagttcaagtacattggtgaacaaaatacaccaagactcccctcctcatgggtattttaggatggataataaaccacaaatataatagataaacattagaaagtattttagaaggtgatacatgctatgaaaaaagaaataacagcagggtgccaagcatggtagttcacacctgtaatcctagcactttggaaggctgaggtgggtagactgatagagcctaggcgttgaagaccagcctgggcaacatagcaagacaccatttgtacaaaaaaatgcaaaaattagaggtgggtgtggtggcacatgcctgtactcccagctactcgggagactcagatgggaggatcactgctgcctgggtggatgaggctgtaacaagccatgattgcgccactggattccagcccgtgtgacagagtgagaccctgtttttccccacccaacccccggcaaaaaagaaggagagcagggtgagtgggggttacattgttaaataggaggtcagagcaggactcgccaaaaaagtagcgtttaagcaaaaacttgaagaggacattagctttgaggtggttggagaaagcaggctttaggcacagagaagagttagtttcaatgtcccgaaggaggggcatgcccaacgggaatttccagagcagtgtggggagcagagtgagcaaggcgatgagatcacagaggtgtcggatcttgccagaccttccaggccattcattgcacagacttggctttttctctgaatagggaaccactgggaggttagagcaaaggagtgacgagctctgacttagctttcacaggatcactctggctgctgtgttgatcctggactgtcagggtacaaaggtagaggagacattgcggtgatcccagggccctggagagaggagtggcagtggaactgatgagaggtgctcagatgctggagagaactagagtgacttgcccaaggtcacacagctagtcagcaggagagccaggtaagagcccaattctcccaaattacaatgtcatgcttaatccactacccttctcttcagtctttcggcacctcgtggccatgctgagatgcaggtttcacatgtgatttttggttgtcttggaggcatcaatgcatttgagtatatgtctaggtatctcattccagcaccattcttttgaaaatgttttggggctagaaggtagtatatcagacatccactctttgctacacacactgatacctggatatgatttctagatatttttgcaaaaattcttgtatacaccctttttctctgtcgaaggcacatctagtgataccaatatgacactgaaggcacccgaggtggattcctggcaagcttctactgtgcataagatgaagatctgctcttgtctgatggctactccaggaagaagcagatgagctacggctggaattatagccatgatgcttttctctaatctagaaggttcctgaggatgtcagtgactgatctgtggcttggcatgttcactgagtcggttctgtccacatttccagtctaatgtagccaggaggggttctcatagcagacactctgaggtgtctcagcctttagattgcaggagacagatctggacttaggccgctggcttaggggatgccgccaagtgacctaaagagtttcagagtcttaactaaaccggaggggatagcttcagtcttgccacaacttcctaaatgggccttccagcagaaccattagactgcaagtgccaaacagacatgttgtattcaccgccttgtctccagctcccccagaaccatccatggtgcattagaaaaaaagaatatttgttgcacatataggtaaatttgggcctactctttagaaatgatttattcctcagtttcggattcctcttttttttctttcctatttcttgtcctttctcattactttttatttatttatcaatttatttatttcagggtcttgctatgttccccaggctggtctcaaactcctggcctcaggcagttgcctcgcttcagcctcccaaggtgctgggattacaggcatgagccactgcacctagcctgccttcttcattttccaaatttacatttacatttgagaactcctccctcaccccaccccatgtccgtttgtcatttgctcagaatcaaaccacagaggcccagaccgggcacggtagctcacgcctgtaatcccagcactttgggaggccaagaggggtggaccacctgaggtcaggaattcaagaccagcctgaccagcatagtgaaaccccatgccttctaaaaatacaaaaattagccaggcgtcatggcacatgcctgtaatcccaggtactggggaggctgaggcagaattgcttgaacccggggggggcggatgttgcagtgagctgagatcatgccgctgcactctagcctgggcgacagaatgagaccctgtttcaataaataaataaataatgggcccatatgaatgcccgtaaaagcactggccgtaatcatatctaatgccctaatacctggaagcttccaagtcccacgacagcaaagtcctggtgcttttgaaagcagaaattggctcatgcctttaatcccagcactttgggaggccgaggtgggcagatgatgaggtcaagagatcgagaccatcctggccaacatggtgaaactccgtctctactaaaaatacaaaaattagctgggcgtggtggtgcacgcctgtagtcgcagctactcgggaggctgaggcaggagaatcacttgaacctgggaggcagaggttgcagtgagctgagatcacaccactgcactccagcctgggcaacagagcgagactccgtctcaacaacaaaaaaaaagaaaagagaaaagaaaagagaaagcggaaaccgaagcacagtgattctgagtgcaccctttattctcatggctagttccaggtaagttggagatgtaccgtggcctacataacgtgcctaaggatacggacaatttctgtcaaagtgtaacaatgagagttctatcagacactgcaggctgatggcccatgtcgttcattcaccgtgggtgctctagccctaagtcactttgcagaagtttttttgttttttctcaagccacatttctttgtcctcccaccagggaaaaccccagctgacatcttttcttctggagacagtacaagatgacgtctttggagggctcttcaaataaagtatgatgcaaataaaaagattttgccttttggaaacttcttccgaaaccccttatggtatttcatcaatcacaaaaatgggaattgagtcacctgcccgagccctgtaaccaggacagttgtagcacacgctgaacgatggccctgacagatgtgactgagtctccctcgccttctgttttgtttgtgtgtccagaactcctatttgtgagaaaattgtattccctgcgcttgagtcctggtcttctgagctgacataaggaactgtaagcagtgggggctgccatgcagcagggctccatctgccccaagtctctgtgactgctgctcgctgcacagaggccctgggtgatcagaggctgcaccggtgaacctgtgcagccccgcgcatcccgacaggccacacgtaatttctgcctctcagtgaaatctacctgcaagatttgctcttattttctctgcagcaaacaacaggatgaactttattttctcattgaaaacaaggtgccgggaagtgattgcgcacccgtcggagatgcacagagccttgggcttcagactctcccctgaagccccgaaaagccaccctcattgaccacatgtactgagtgcccatccgagcaggactgcaggagcggctggactgtccatgacccctaacaacccacatgtccagagatggcgtttctgtcttcttgggagggaggcctgttgagctgcatctgcacctcatgatgcccggagtggcacgtggagctgcacctgcacacttggcttctggttgccggggtgcccagggagttcaccatcggatagcagcccgctgcctgcctctctctgccctcctgtgggacactcctcggctcccatgacctctcggagcccacatttgccctcctgctcacctcaccaggccctggaagttgcaggctgcaggtgggcaagggaggctgccaccactgcttgggatccggtctcctggtggctgcctgcagagaccgcccagataaggggacgaggagttggtgtcctgtgagacaaacttcagtcaatggcagacaagagtcagtggatgaagtctgccttccttcgtggactgttttatgatactgtttatagtttagtcagcctctccggagacatcctgtaaggcagaaaaatcacggttttgtgaggagctcagcaatgcacttgtgtttgctctccctccttccctccttgctccttccttccttccctgcttcctccttcccctttcttccttttctgcttcctcttttcccccttcccccttttttctttcctcttttctccttcctccttccctccttccttcactgatactttttgggattactctccctagtaaagcataagcacaaatgccttgtccttggttctggtttccagagaacctgggctaagataagtttattccagaatatcttgatcttgaatgtccttctctgtctccttccttccttctttcctccctccctccctccttatttcctcctccttcttttttcttttttcctttcctttcttttccgttttttttcttttcctttctttctcttttcttttgacggagtctcactctgtcgcccaggctggagtacatgacacaatcttggctctctgcaaccaccacctcccatgttcaagcgattctcctgcctcagcctcccgagtaggtgggattataggcacacagcaccacgcccagataatttttgtattttttgaagagatggggtttcaccgtgttggccaggctggtcttgaattcctaaactcaagtgattcgcccgccaaggcctcccaaagtgctgggattacaggcgtgagccaccactccgggccctgaattctttttgcaatttaaaacagtgtttgcaaaatttttgacctaggccattcatcttcttatttttactatgttatttatagaaggaatatatatttatagtagaaaatttggaaaaggcagaaaaatataaataagaaaatgaaaataattcaccagccattactgaatgatgaagaccttgaactttttggagaattttcttccagtttttattctttgcatcaagagtgttcattttataagtagttgtccccaaaacagccagacctattattattattttttttatccagcaattggatttttttattttattttattttattttatttattttattttattttattttttattgatcattcttgggtgtttctcgcagagggggatttggcagggtcataggacaatagtggagggaaggtcagcagataaacaagtgaacaaaggtctctggttttcctaggcagaggacgctggggccttccgcagtgtttgtgtccctgggtacttgagattagggagtggtgatgactcttaaggagcatgctgccttcaagcatctgtttaacaaagcacatcttgcaccacccttaatccattcaaccctgagtggacacagcacatgtttcagagagcacagggttgggggtaaggtcagagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcgggggctgaccccccaccaccctcccggacggggcagctggccaggcagagcggctcctcacttcccagtaggggcggccgggcagaggcgcccctcacctcctggatagggcggctggccgggcggggggctgtcccccccacctccctcccggatggggcggctggctgggcagaggggtcctcacttcccagtaggggcggccgggcagaggcgcccctcacctcccggacggggcggccggccggaaggggggctgacccccccacctccctcccggacggggcggctggccgggcagaggggctcctcactttccaataagggcggccgggcagaggcgcccctcacctcccggacggggtggctggccaggcggggggctgatccccccacctccctcccggacggggcggctggccgggtggggggctgagccccccgctcgctccgggactgggcgggtgggccggcgggggggctgacccccccccctccccccggcccggggcggccggccggaaagggtgcgacccccccacccccctcccggacagggcggctggccgacgccccccccgcctccctcccggacggggcggctggccgggcagaggagctcctcactttccagtaggggcggccaggcagaggcgcccctcacctcccggacggggcggctggctgggcggggggctgaccccccctcccccttcccggacagggcggctggccgggcgggggctgacccccccacctccctcccgggcggggcggctggccgggcagaggggctcctcacttcccagtaggggcggccgggcagaggcgcccctcacctcccggacggggcggctggccagatggggggctgatccccccacctccctcccggacggggcggctggccgggcggggggctgaccccccacctccctcccagactgggcggctggctgggcggggggctgacccccccacctccctcccggacggggcggctggccgggcagaggggtcctcacttcccagtaggggcggccgggcagaggcgcccctcacctcccggacggggcggctggccgggcggggggctgaccccccctcccccctcccggatggggcggctggccaggcggggggctgtcccccccacctccctcccggacggggcggctggccgggcagaggggtcctcacttcccagtaggggcggccgggcagaggcgcccctcacctcccggaaggggcggccggccggaaggagggctgacccccccacctccctcccggacggggcggctggccgaccccccccccgcctccctcccggacggggcggctggccgggcagaggggctcctcactttccagtaggggcggccgggcagaggcgcccctcacctcccggacggggcggctggccaggcggggggctgatccccccacctccctcccggacggggcggctggccgggcagaggggtcctcacttcccagtaggggaggccgggcagaggcgcccctcacctcccggacggggcggccagccgggcggggggctgacccccccacctccctcccggacggggtggctgccgggcggagacgctcctcacttcccagacggggtggttgccggacggaggggctcctcacttctcagacggggcggttgccaggcagagggtttcctcacttctcagacggagcggccgggcagagacgctcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggtgctcctcgcttcctagatgggatggcggccgggcagagacgctcctcactttccagactgggcagccaggcagaggggctcctcatatcccagacgatgggcggccaggcagagacgctcctcacttcccagacggggtggcggccgggcagaggctgcaatctcggctctttgggaggccaaggcaggcggctgggaggtgtaggttgtagtgagctgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccgtctccaccaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggagggagagggagaccgtggagggagagggagagggagagccagacctattatttttaaactgtctctcatgcctgacactagactcatttgcagatttttaatttgtattttttagagacaggatctcatgctgttacctaggctaaagtgcaatggtgcaatcatagctcactgcagcctcgaactcctgcactcaagtgatcttcctgcctcagcctcccgagtagctgggactacaggcaagtgtcaatacacctggctacttttcttagtttttattcttgtctcactctgttgcccaggctggtctcaaattcctgggctcaagctatcctcccaccttggtctcccaaagtgcttggattacaggcatgagccaccatgccggatcttatttgcagtttacatggtcaacttaaattggagtaattcaaacccgtagggtgagattcctaagtgtattctcagaaattaatggacattgccaaagtggctaacatgctttaaaaatgccttagtcattgatagcttttctgcacacacgaagcactaataatactctcacaatgacgctcagagaacaatagggcgtgggaggagggctggtgatgccgttctataaataagaactaaagaaccatccggaggttcagttgagagatattaggcagttaaagtgattattgctaaaataaagaatattcgttttggtttattggaagctatggtagcattttgggagactgtgattagttattaatagcacagatggtgatgagtcaatcttggcttctctgcttgtaagttgtttgacgttggggtattactgaaactttttttttttttttttttttgagacagagtcccgttctgttgctcaggctggagtgcagtggcacaatcttggctcactgcaatctccgcccaccaggttcaagcgatcctcctgcctcagcctcctgagtagctgggatgacaggcatgcaccacctcgcccagctaatttttgtatttttagtagagacagggttttaccatgttggccaggctggtttctaactcctgacctcaggtgatctgcccacctgggcctcccaaagtgcagggattacaagcgtgagccaccacgcccagcctacttaaactttttgagttccagttttctcatccgaaacatgataataggcaataataataaaaaataaaaatcttgcagaattgttcatttatttattcaacaattatttgcttagtgctgtctaacaaacaacggttcaggaggctgtagtgtttgggttatagtagtgaatgacacagacaaggtctcagctatcttggagcccacagcgacagctcagcaaatgacagcatcatcagcactgccacctccaccattgtcatcgttgtcatcggtgaaatttcccttatgttgcatattgatttaagaacattggttagcccagagcactgcattttttaaaaactaaattaaactttttatgttgagataattatagattcacattcatttgtaagaaatattacaaggagatcttttgtaccttgcaaaactaaagtacaagatcacaagagaatactgacattgatacaatccaccagtcttaatcagatttccccacttgtgtgtgtgtgtgtgtgtgtgtgtgtatttaattctaggcaattttatcacctatgtaggttgatatatccaccaccatagtgaagatacagaataggccagcacggtggctcatacctataatcccagcactttgggagaccaaggtgggaagattgcttgtggccagaagtttttgagagcagcctgcaacgtagtgagacctatttttttctaagaaaaaaacagaaaaagaagatacagaaaagatccatctctatgaggattctatgtgttgttaaccattgctccccaccccccccgcccgcccccgccacctcacacagttcctcatctctggcaacaactaatctgctctccatttctttcatttcatcatttcaagaatgttatataaataggatactacaatatataactttggggatcagcatttttcactcagcataattcctcagagattaacccgatccatttttttttgttttttttttggaggtgggtgggaaggaatatccctctgttgcccaggctggggtgcagtggtgagatctcggctcacgaaacttctgcctcttaggttcaagcgattctcccgcctcagcctccagagtagctgggattacaggtgtgcgccatgctgcctggctaatttttgtaattttttttttagtagggtcggggttttgccatgttggccaggctggtcttgaactctggacctcaagtgatctgcccacctcagcctcccaaagtgctgggattacaggcatgagccaccgcgcctggcctaacctgttcctttttattgttgattattattgcaagatggatggaccacaccgcgcctggcctaacccgttcctttttattgttgattactattgcatgatggatggaccacaacttacctatccactcacaaatcgaaggacatgtaggttgtttctagtttttaaatactatgaacagaactgcaataaatatttgtttacaggtttttgtgaacatagttttcatttctctgaaataaatttctaagagtgcaattactgggtcttatggtaataatatgcttcagtttacaataaactgctaaattgttttccagagtggctgtaccattttacatttccacccataatacatgagcgattcagtgtctctgcatccttgctaccatttggcattgtgactgttttttattttagccatttggataggtgtgtaatgatacctgtagctcactatggttgtaatttgcattcccttgacagctagtggtgttgaacatcttttcgtatgcttatttgccatctgtatatccttttcagtgaaaacatagttgttccattttctaaccgggatttcgacactgttgaattttgagagttctttatatattctagataccagttctttgtctgacatgttttttgcatatttttttttcttctcagtctgtagcctgtcttttcatcctctttgaggagaatagagcaaaagattttaattttgatgtggtccaatttatcgttttttccttttatggatttatttttagggttgagcctaagaactcttcgactagctctagagcccaaagattttctatgttttttttctaaaagtctcatagcttttaagtctgttatatattttatgtgaaattccaaaggaattttcagaaatgccttttactttagtaaaagttcatactgatatttccaattcagatttaagattacagagtttttacttctaaaaaattaaatttattggccaggcacggtggctcacgcctataatcccagcactttgggaggccaaggtgggcacatcacctgaggtcaggagttcgagaccatcctgaccaacacagtgaaaccccgtctctactaaaaatacaaaacttagctgggcgtcatgtcacgcgcttgtaatcccagctactcaggaggctgaggcaggagactcacttgaacccgacaggcgaggttgcagtgagctgagattgtgccactgcactccagcctgggagacagagctggacttcatctcaaaaaaaaaaaaaattaaattgaataattaaattaatctcttttcttatatcattgacaattgtagttcctaatgacaataacacaattacttattggctttattctacaaatacctaaaatagttttaaaataaaaatactattattactaaaatgcaattaactgcatttcagatttctatggggctctgtgtcctgagattatacatctctaaggatacacagtaaaattctgtttcacttgataattccacttaatttgttacttcaccttattaattcacttaatggtttcacttaaataattcctttctctgtctgcttgtgccaccagctttatatgtacggcagctatatttcagtttgttttccatttttggttttgctttgtttttaattggtgatttaattttatttttttaaccatgtgaaccatgtaatgttcctgaagtttctaaatgacaccacttggtaagtttcactgaagccttgcttgcctcccagctctctgtagtgttctaacctccactcctacagggaaccatttttattggtttttggtttttgcgtcctttgtttttatttttgttttgcaaatttaggaaaatgtctaattatatttatttctcttttcttatacaaaaggtctcagttctattacactactttatgatagctatgtcatatatctctctcaatatttttttttacaatgtagatataaaatttttgatatgtcttaatatttaggaaggtttgtatttttgttctaattgttatcttggtattcacatatttgtataagagctttgagtcccttttttaatacactgtctatttgctcccaactatgggtaataatgaaattaactaatacccactctttcctctactctttctcatcctgcttccaaaattaaagtgatagccttttactcacagttaatatcggcgagttacttactgagcttattctactttccaagtacttcgttcatcccaaactcagttttttattagttctattatatccatattttcagagtatataatattgaaataccttcttcctttttttttttcttttttttttttttgagacagggtcttgctttgtcacccaggctggagtgcagtggtgtgatcatggttcactgcaatttctgcctcctgggttcaagctaccctcctacctcagcctcccgagtaaattggattacaggcatgtgccaccacactcggctaatttaaaagagaaaattttggtagagacaagatgtcactatattgcccaggctgatcttgaactcctggactcaagtaatcctcctgccttgccctcctaaagtaccgggattacgtgcgtgagccaccatgcagggcctacccttcttccatttttattctcattattttttcttagttctacggataaataagctcatcaaagactttgtgctgaagcttcttatgattattttgaatggttgtttggagctcattttcatagatttcttggaaaggcatgtgggaacaatattatctgaggtcttgcatgtttctttgtttgtttatttatttatttttatttattttttgggacagagtctcgctctgtcacccaggctggagtgcagtggcaccatctcagctcactgcaacctctgcccccagagttcaaccaattgtcctgcctcagcctcctgagtagctgggactacaggagtctgccaccatcatgcctggctaatttttgtatttttcttagggacagggtttcaccatgttggccaggctggtctagaactcctgacctcaggtaatccgcccgcttcggcctcccaaagttctgggattacaggcttgagccaccgcgcccggccagtcttgcatgtttatagcggtgatctttattgttgatgagtttgactggatataaaatccttggctcacattttctttccttgagtattgtaaatgtgttgttccattgtcttccattatgaagtgttattaataaatcggatacaaattttatcttttttccgttgtagttctcatttggtttttgtttagatactcagataattttttctttctctctaattcccggtagtttaacaagaatatctcagtgtgaaatgtatctctgaatacatctctgagtgattttcctaggtacatagtatatcctcttaattgtagattcgagtatttttctttttttttttgagacaggatctcactctgtcgcccaggctgaaatgcaatagtttgatctcggctcactgcagccttgatctcctgggctgaagccgtcgtcccacctcagcctcctgagtagctgggactatggacatgtgccactatgcttggctaccttttaattttttttttatttgatagagatgggttctcattatgctgcccaggctggtctagaactccttggcccaagtgctcctcgcctcagaatcccaaagtgctggggttacaggcatgagccaccacgcccagctcaagtatctttttatttgtcaaaagattacttacactattatttgttctgatctatttatttgatttcctttttaagaaactcctatgtcatattgtcatagatttcctttgccaatcttctatatctatcttttaaaaaatatttttaaaaattttccgtttggactgggtgtggtggctcatgcctgtaatcccagcactttgggaggccgaggtgagagaatcgcttgagcttaggagtttgagatcagtctgggcaacatggtgagacccctctctataaaaaataaaaagattagctgggtgtggtggcgagcacctgtagtcccagctactcagaaggctgaggcagggggattgcttgaggcggggagattgaggctgcagtgagccatgatagcgctactgcacaccagcctgggcgacagagggagaccgtgtctcagaaacaagcaagaaacaacaaccaaaaaatgtcccgtttgatttttgtttcctcctttctaatctcaatgtccttgctatactttctgtaatgcctattgctctcatgtaacttctagcttagtcttcatttataaaatattattttctaatttttttctgagctcttttgtcacgtttctattgttcagctatctaatttttaatgtatttatgatatgtttctgtagttcctgaagtttttggaattactttgggttcattttatattaggacacatttttcatttgctttgtggacatatttttcttgcctttcccttgcatttttatctgttagcacaattaatatttttttttagtttttctttttctttttttttgagacagagtcttactctgttgcccgggctggagtgcagtggcgtgatcttggctcactgcaacctctgtctcctgggttcaagcgattctcctgcctcagcctctgtagtagctgggattacaggcgtgcaccaccacgcctggctaatttttgtggtttttttagtagagatgagattttgcccttttggccagggtggtctcaaactcctgacttcaggtgatccgcctacctcggcctcccaaagtgctgggattacaggcttgagccaccacgcctggaataatgtttatacttatatgggacagtttttttcctgtaatttgaggacagtattgtcacacagagagtaggagataggcccaggtagctttctggcttgaaaactcccttctctattgttatttcaaagttttcccaaaagtggccattctctgtcttcacctccacagctatgagatctttctcctttgtattgtctttctttttatacccggtgccctgatctgatcaatttagattctactaccagaagctgcctttttttttcaatttagggtaggttcttttcctcctagcagaagggttttgttgagtacatctgaggtcctccaggacctaggtcatcctagtgtgtccggaattggtgggttcttggtctcactgacttcaagaatgaagccacagacccttgccgtgagtgttacagttcttaaagatggtgtgtccagaatttgttccttctgatgttcggacgtgttcggagtttcttccttctggtgggtttgtggtctcgctggcttcaggagtgaagcctcagaccttcgcagtgagtgtcacagctcttaaggtggtgcgtctggagttgttcattcctcccagtgggtccgtggtctcactggctcaggagtgaagctgcagacctttgcgatgagtgttacagctcataaaggcaatgcggacccaaagagtgagcagcaacaaaatttactgcaaagagtgaaagaacaaaccttccacagtgtggaaagggacccaagcgggttgtcactgctggctcagacagcctgcttttattcccttatctgaccccacccacatcctgctgattggcccattttacagagagctgattggtctgttttgacagggtgctgattggtgtgtttacaatccctgagctagacacagagtgctgattggtgtatttacaattctctagctagacataaaagttctccaagtccccactagattaactagacacagagcactgattggtgcgtttacaaaccttgagctagacacagggtgctgattggtgtgtttacaaaccttgacctagacacagagtgctgattggtgtatttacaatcctttagttagacataaaggttctccaagtccccactagattagctagacagagcactgatcggtgcattcacaaaccttgagctagacacagggtgctgattggtgcatttacgatcctccagctagacataaaagtactccaagtccccacccactcaggagcccagctggctttgcctaggggatcccacgccagggccgcaggcggagctgcccgccagtcctgtgccacatgcctgcactcctcagcccttgggcgatcgataggaccaggcagggggccgtgcccgctggggaggcttgagttgtgcgggaacccactgcagggcgggagcgagctcgggcatggcaggctgcaggtcccgagctcttccccatgcagaggccgctgagaccgggtgagaattcaagcatggcacgggcccgccggcagtgctgggggacctggcgccccctctgcagctgctggcccgggtgctaagcccctcactgcccggggccggcatccggcaggccactcctagtgcagggcctgccgagcccacgcccacctggaactcgcactggccagcgagcaccgcgcgcagccccggttcccgcaggcacctctccctccacacctccccgcaagcagagggagctggctccagcctcagccagcccagagaggggctcccacagtgcaggggcgggctgaagagctcctcaagctcggccagagtgggcgccgaggccgaggaggcaccgagagggagcgagggctgccagcacgctgtcacctctcactagtttcctctgagcagagcccgctcatgtagcgtgacttgctgttggcaagggctgtgttacgagactctcaggctgactaaattctcagcttactctggcccaaaagacgtgatcatgtgctgctggcttcagatctgcagccagtgacatgagctgtattgggagtatttagaccacaaaccccagccaacgctacaagtcaaggttggttgtgttgcgtttgtttgtcttggagagctgatttcactggcctttagccccatcagaattccccttcctttcttcccttaggttcttcacacaggtgttaacactgcaagggttccaagcgggttttgttgatagtggtggtttgatcctcctcgtagttattctggagttcctggggaaacttttgtcatctaattttattaaaaatactgtctgagagttgtttaaatgttgtcatcctattgctgtgggtatctggaaaaactggtaatggtcttacctggactggaagcctgcggaaatcctttggaatgtaattggtaacagtgctcatgtctttatgatacagtaataagtaacattgtcatgtttttatagtagcacttcacagtttacttaatccctttatgagacagagcaggcctaatttcattttgtggaccaggaagctgaggtctataagagttaaataatttgtccatttatagctaataaatggtagagctggagtttaaactcaagtttgtaactcaaatctagcgatgtatattaaagtataaatacatttgcaaagaatgcttaatttgagctagtgttttatcaaaatctagggcaatattcagagttttgacctctaatggactaaatatcccaatatttgaattccttagtcacccttgcactgaagcatcttctctctccagtctctccctttttgtaaatagtaccccactctcctgggtactcaagctggaaaccaggaagtagggcaaagaggtgttccctccacattgtaattcaggaatgccagaaaattgtcttctcttttcttcatgcccctcatacaaatccctgctggctcactgatgcctgaaattccatcatttattgctttggctcacagccaggagaagggatgccaggaagccatgcacatgctttccttcctagtgttgactgggtgccaggcatctgttattgactctccatcattcttctgcattacacctttttctaagtgagggaaccaaagctcaaagaaattaagtaattttgttagggtcacaaggcaggttgatagaagatataataactgaacccaagttgggttggctcccaaatctgtgatttagcttccattctaggctaatatttatgtgggcctagcactgcagtaagtatttgtcttactgcatacttgttctcagggcaaatcagcgtagcccctgatgaaagttccctactcatatcaacttacagctcactgcagtgcactcgcaaggcttctgactgcctgaggtcattctctggctcctgctctctccagcaacgctaacatgacagactaaaagtgttacagaaacactggggggctcagtctaggtcctgctgctcgccgcacagaaagcctatcactgagacaacagtattaccaaggaagagggctttaatcgggtgctacagctgaggaggtgggacctcaggctcaaatccacctccttgattgactaaaactagaggtttatatagcagggaaggaatataacaatgtgtgagaaaacagtaactggggaggggcaaggaagcaatcccatgaggaatgaggggcctggcatctcgttgtctggatgtgggtaactggtgagtttcaattctttgatacttttttttttttgagaggtctggaggtcatttctgaggaaggaactcgcagaagacaaatgttaagtttcaagctttttaagaccagaagggtcaatttctatgtttatcttaaaaactatccgtgggactatactgggtcagtttcaaaagcatgggaaaattaactctcccaccccaaccccagcagccaagcagccatcaaccagtgactgatgggaatgggtgtataaaagccgcagctcccttgcctgtcgcgagggaaaaccctgcactgactctcggaattctacgctggaattaggctccagttgtccacttactgacacttctgataatacctcctttatcagctgcccttcttaccctgtctcagttcccagcttaccaatagatatttcctgggatcctttccaaaataatctaatctacttgcacttgaatcttggtgttggggttctcaaggtctgcttctttggaacccaaactaaggcaattggcatcatccgaaatacagattttcaggaggagaaggattggtggactttgagatcatcaggccttgaagtgaacagaagaagagctgggccactctcatttgttcccacatcattactacatccacgtgttccttagcccatcagtcacagccagggagatggagtcacacgttcgtccgtgaacagatattatgccagttctagggaacagggataatgcaatgaacaaaatggataaaaagctctgcccttatggaggttatagtctaatggctgccaagagattcttcaaaagaaccaaatggatcttctaggatggaataatacatatctgaaataattttaaaaattgtataggcttaacttcaggagaaaggacatgaatttgaagacagatgaaaaatcattcaagctgaagcacattgagcaaaaatatatattttttaatgagcagagcctcaataattgtgggacaatatctaacgtaattagaatcttagaagaagcagagagagaatgtggcagaatatttatttgaggaaaatgatggcagaatttccaagattgagaaaaagtaattcaacttgtagacccacgaagctcagcacctcccaaacaggataaatttaaagaaaattaccattaggcaaatcatcagcaaactgctaacaaacagagataaagcagccaaagtaaaaagacacattacatagaggagaacaaagatcagaaacaaggcagaagataatggaaaaccatctttaaagtgcttatagggggaggaaaaacctgtcaacctgaatttcataactagtaaaagtgtcctgaattgtcccgaatgaagccaagtgaattacctggatcatctgatctgtggaagcactggtttggataagttaggctccaacatgtgtcagagggacagcagagtgtgatcgggacccagcctgcctgagtccaatttctgactccatctctcactagccgagtgaacttgggcaagttcctcagtttctctctgcctcatcttttcatctctaacatgaagatgataatatccacctcacatgggtattttatggattaagtgaattatttgatttccaacagtctgaggattttctcggtatctttgttattgatttctagtttaattccattatggtccaagaacataagaacatattttgtatgacttctattcttttatcttcattttttaattttttttttttgagatggagtctagctgtgtcacccaggctggagttcaatggcgcaatctcggctcactgcaacctccgcctccccggttcaagcgattcccctgccccaggctcccgagtagctgggattacagttgcctgccaccatgctcggctggtttttgtattttttagtagagacagggtttcaccatgttggtcaggctggtctcgaactcctgacctcaggtgatccgcccgcctcggcctcccaaagtgttgggattacagggtctcactctgtcacccaggctggaatgcagtggtgtgatcatagctcactgtaacctcaaactcctgggctcaagcaatcctcccacctcaccctcctaagtagctgggactacaagcacacaccaccactcccaactaatttttaaaaattttatagagatgaggtctcactttgttgcccaggttgatctcgaactcctggtctcaagtgatcctctcaccttgacctcccaaagctctaagattacacgtataagccactgcacccagccacagattattttattttattttttcttatttttcttccctttgatctatacaattaacgcacaaattcttttaaattgtaaatgtttgtttaatgactcaggatatagtctatcttggtaaatatttcctatgcagttgaaaataatgtgtattttgttgttgggtggagtgttctataaatgtcaactagatccagttgattgatagtatcgttcaattcttctaaatccttgctgattttctgtcggctggttgtattactaagagaggcatgttaacatctccaactataattgtggatttgctcaagtttcctttaagctgtgttagttttgctttatgtgttttgaagctctgttgttacatgcatatgcctttaaccacaccattgcatgtgagctgtgacctgaaagataagatgcaattttaaaatgccaaagccaggaataacattccatgaaataggcataactattttaaaggcaccagtgaatgagagggcctggcatagtcagggaatgaatgacaagcaccatatgaagatagcaggagagaatcaccaatgagccataaaatccatatattttgttgtgctaacctttgacctgaattatccacaaggatgcgaagggaattatctggatcatttgctctttgaaaacaacaaatccagatgacttaggctgcaaagtgtgtcacatgggcagtggagcgtcatctgcagtcagcctgcctgagtcaatttctttttccaaaatgcactagctgagtggacttgagcaagttcctcaactcccttctgccttgggttctcatctgtcacaacagagtttcaaaaatagatgaaaatattctcatctgataatagtaatatcagctcagagggttattgtaaggattgagttgacccatgaaaagagcttagaatggtaaccactcaacaaacaaaatctacttttttcaaaagcaactatcagaattaattgaatgaactaggcagaatagcaccttgctgtcttagtctcctaggggctgccaaacctaagtaccacaaactgggtgactttcaacacatacatttattctcttacagttctggcggccagaagtctgaagtcaaggtgtccacaggctaagctctctctgaaggttcttgtgggcaatccttcctggactcttcctagcttctgatagttgctggccattcttggtgttccttggcttttggcagcgtaactacaatctcagctctcttccctctacgtgatgtttccaaatttccctcttcttatggggacatcagtagttagatgagggcccatcctaatccagtatggcttcatcgtaactggaatacatctgcaatgaccctatttccaaataaggtcatatctacaggctccaggtggacatgaatttggtgggaggggacagtcttcagcccagtacacatctcaattgcccacattccttgacgacttgctctagatagccaattttctagaaggaacaaattatttttctttgaccctttggccaaaaatatttccaaatttctttgctcacttttcaattttttgaaatcaaagataacaattccaattgcacttcctttatagacctaggctgtcagtcatctgtcacagaggtctgtgacaaggttttaagtccccatgctctctggttcttgggttggcacactagagtttgtctgttttctttccatttatggctgtaacttgtcctttcttgttgctgtgggcatttgggttagcgtagagcttctctctcatttctaaatttctgtgagttaggaaccagaactccatgtttgctatagttgtagaatttagctttagtgttttttttttttttttgagagggagtctcgctctgtcgcccaggctggagtgcagcggcgcgatctcggctcactgtaagctccgcctcccgggttcacgccattctcctggctcagcctcccgagtagctgggactacaggtgcctgccaccgcgcccggctaattttttgtattttttagtagagacggggtttcaccgtgttagccaggatggtctcagtctcctgacctcgtgatccgcccgcctcggcctcccaaagtgctgggattacaggtgtgagccactgtgccaggcagctttagtctttataatagaccacgtggcttctcttgaatggagtaaattatattttatgcaaagattgtatgtagcacacacagaaataaaccagaatcctaaaggtttaccactttggaatttgctgagaaaacctgaactcaacgagacagtattataactcatttagagagggacgttaacaattctgtattttgatattagtttcctattccttgtaataaaggatcagctgattgcatttcagcgttgcagcttagggcacagcctctgtctcggtggtctgcgtgctactggctcttgttttctgcgtcgaatccttccccttcctttaaggttattctcactaatcacagctccatgcacttgttcaaagcacagtcctgaagcacacaagcttcgctaatgaatctctttagaagaccttgcctccctcccatatactctacaaaatggggagtgtctgctttgcaagttaactggaatggatgcccaatgccgatgctgcagctctggccgtctgtctgtctgtctgtctgtccctctctctctaactcaggcaccgtttttctaatacctgtgaattctgccccatcaggaggccccttttccacttacctggttcccatgtaggcatttgctatagagttgaactgtagatgggtgtagcgttactctcatgacctaatctgataatgtgcagaagagccggtgataatggatgcacagttcctataagactgagccttggattcccatgttcgttcgcctctcgccccttttttgtcgggattcaataaatgggaagtcgaaaattcaacactcaaataggagagtcaactatgtaaaggcagactcctctaagcattaaaatgaaggctgaaatactaacgtccttgtgacctgcaatcatttcttctaagaggagggtcagtagactgtgtttgttgagcatatttttagaactttgccattgaatccagtcgtgcaggtctgggccttgctctgtggaaacggtagtcacggccaagcctgactttgctgcctttgcagctcccacctgaatcctcctcctgtttgaccacgccttttctgcccacccatactggagctcacttcctctggcagtgtggatcagaacgtcccgcttctttttttttttttttttttttttttgagacggagtctcgcactgccgcccaggctggagtgcagtggcgagatctcggctcgctgcaagctctgcctcctgggttcaggccattctcctgcctcagcctcccgagtagctgggactacaggcgcccgccaccacgcccggctacattttttgtatttttagtagagatggggtttcactgtgttagccaggatggtcttgatctcctgaccttgtgatccgcccgcctcggcctcccaaagcgctgggattacaggcatgagccaccgcgccctgccggcagagcgtccagtttctaaaggatctgccctgtcctgcgttctgtttcctcaaggcggagcgggacaccgactagcctgacagcttcctgggatttttttaaattttgtttttatttatttattttgagacagagtcttgccctgtcgtccaggctggagtgcagtgctgcaatctcggctcactgcaatctccgcctctgggattcaagcaattctcctgcctcagccccccgccaagtagctgggattgcaggcgcctgacaccaggcctggctgatttttgtatttttactagagacagggtttcatgatgttggcctggctggtctcgaactcctgacctcgggtgatctgcccatcttggcctcccaaagtgctgggattataggcgtgagccattgtgcccggcccttcctgggattttcaagctgaaagagctctacagataaatgacaggagttaattttagtaaaaagcgggagaaggggtctgtgtgtacacatatgtgttggcattggtgtgggagtatacatgtatatgtgcttgtgagcacacatgtacagtcatgcaccgcataaccacattttgattaaccacagactgcgtatccagtaacggtcccgtgagattataatgctgtatgtttcctgtaccttttctaggtttagacacacgaatacataccactgtgttacgatcgcctgtggtattcagtacagtcacatgctgtacggatttgtagcctaggagcaataggctccaccatatcgccaggagtgtagtgggctgtaccaactaggggtataagtgcacactgtgatgttcatacaacaatggcattgcctaaagacacatttctcagaacatatcctgtcattatgcagcacatgatgcagtaatattgaacacaggtgctttgggggagtccccccagtcactccatatccaagatttactctctcatacaatctgtccagtaaatgatacacagctgaaatgatcttctctttttggttcagtgagcggatcccaagttagaacattctaccaaataggagggattagtgagccattatcttcctcaggaatttttgctatgagaattcactgtttatttatgaggccactggtttctttaaaatgttggaattcggtattttttagttaaaaacaatttttttgagacagagtctctctgtgtcacttagtgaagggctgaagtgaagtggtacaatcatactttactgcagcctcaacatcctgggctcaagcgatcccctggcctcagcctcctgaatagctgggactacaggctcgcacactacgctcagctaatttttgcattttttgtagagatgacgtttcaccgtgttgcccaggctggtctcaaagtcctgggctcaagtgatccacccaccttggcctcccaaagtgctgggacttacaggcatgagacactgcactggccttaattaaaatttttattttgagatagtttagaattacatgtacttgcaagaaatgcatttagtacttttaattcaggtactagtttcacagtgccttacgaactgtaggcatgttcagtatacaacgattgacgggtagattggtaaaataactataatttgtgccttacaagtgggcttttgagggaaatatgttcaggaattactgagataactacataagggttcattataatatgtttggaaattactgagatatatatatctttacatatgggtccatggatagaaagtaaatcggctgggaacggtggctcacgcctgtaatcccagcactttgggaggctgaggcgggtggatcacgtgaggtcaggagttgaacaccagcctggccaacacggtgaaaccccgtctctattaaaagtacaaaaaaaaaaaaaattagccgggcgtggtggcgggcgcctgtaatctcagatactcaggaggctgaggcaggagaattgcttgaacccgggaggtggaagttgcagtgagccgagattgagccagtgcactccagcctgggtgacaagatcaagactccatctcaaaaaaaaaaaaaaaaaaaaaaaagtaaatctggatcattcagtgtctttgtgtcttgttttttgttttttatgcatttctcacttttaagtttttgggttttttcatttttaccccataccatatgcatgtagtcccaatatatcttgtggttgttaattggtgaacgtgatgaactcttgaaatgctagcgttttcttcacttaatcgggcaggactctgaggagtaagctgagggtggagtcctgtggctggggagagatgagcgcgggacagcagcccctctctgcagagcctcgaggcttctgtggccccgtggggtcagatgcgtggcatggcttgctggtcttgttcccatggcacagaagaaactacacttccttttgcccaaactcagccaccatggagcctactcctcagtctttcatttacttctagaatgctgacaggtgagaatgctacctccgggctgccaagccacaaagcgtgacagcccgctccctgggaaccacaaatatttggaatctgaagtggattgggaactaaaaatacaacaccttaagaaactacagtttggggctgggcacagtgtcttgcgcttgtaatcccagcactttgggaggctgagatgggcggatcgcttgaggccaggagttcaagaccagcctggcgaacatggtgaaaccccgtctctgtaaaaaaattgaccaggcatggtggcaggcgcctgaagttccagctacccaggaggctgaggcaggagaatcgcttgaacccgggaggcaaagactgcaatgagccaagattgtgccactgcactccagcctggacaacagagtaagaccctgtctcaaaaaagcaagcaaacaaacaaactgaagtttgggaacaagttagccaagccgggactcccctgaaatgcattcgataagcattgcatgaaagctgacctcagattgtgccactgcactccagcctgggtgacagagcaagactccgtctttgggggggggggggggaagagtttataagactgatagttagtggtttcttcttttttttttcttttagtttgatagaaatgcactccgccagctgagcatgtagtttggagtgagagcaggttactttctctgtgggagacagaaatgttagagtgagggtcccgggggagctggggatgctggctatggctttgcggaaggcttaaacggaaagcgacatggaatttgaaatacatgttttacaagtggagggtgtggggcggtgtcctggattctgccgagcccgcaccaagtgtcctgtcacacaaggcagaaggggaggctggccttgcgcctcaaatccctgccaggcaaggcctctcgcctgcctccttaggaccaaagccacctaacttctgcccaggcgaaggcagtaaacgtctctaactctgcggaaggcaaaaagtcaagtcacacaaagaaaaaaaaacaaataagcaaacaaaaaataaatcatttgggtgagctgtttgctgaggttttaaagctgtcctcttgaacctgaaaggaacgtcctggcgcggtgacagcagtggctggttgtgcgtgggctgcagttcccaaggccgtgagcaggaggcgctatcaggatcaaaggcgggaccgtgggtcttcagggccacatccgtgagaatcgctgacgtccgcagggagggagcctcggtgggaaggctggggacggggcgtggggaaggctggggacagggcagggaaagagcaacggtggtagatgcgaaatcaagcccggatggcgaggcagtcccaccgtgttacttacccttcctccctaacattccatagaggaaaaatctggcgacagctgacatcaaggggagatctaaaagagaagggcagaagccacccccaaaaccccagggaagtatggaaggcggaccgctgtttcaggccgcttcaggtcctgaactggggcgcccgcctttctccgccctttccctcggcctcccagcgacttctccactaaccgccccagtgctgtttccttggggctttccttgagccccaggtctccaaatccagaatgagaaactccgagagtgcaaaggagagggaggagatttggaagcagctcccgggatgtttggctctgagtctggtggtaaagatcagtccttggccttcttgtaggcaaaagggttctgttctgtatgcctatgattaggggtgccaggcttcgcaaataaaagtgcagcgtacgccgacacatgctacaacatgggtgagccgtggaagcctgctgagtgaaagaggccagtcacaaaaaagaccacataccgcatgagtccatgtatgtgaaatgtccagactgggaaagtctataaagacaggaaataaactattggccattcagggctgcagaatgacgcagcagggatggggagtgacttgataacagccacagggtgtctttttgggtgataacaatgttttaaaattagatatgtggtaatggtcgagtaactgggaatatactaaaccccagtgaactgcacgctaaacgtggtggaattttataatccatgagtatcttaaagctgttttataaaacacaggatacccagttaaatttgaattttatgaatagataaatcatgaaaagaaatttagtataagtatatcccaagcaatatttgggacatatttatatttaaaatattttcattgtttatctgaaattcaaattcattgtttatctgaaattcaaatttaactggatgtctggtattttgtttggcaactctatgcttctaaatgtctcagaaagcatcaatctacagcaagagtaagaagaaatagttcatgtgatgtcatttaaatagatttaaagagacttctatatactttgggcatcaaaaaagcttaattaactgagagtaagaacttcttgatttaatgttaattttaaaaattctacttgtagccaccaaggtggaaaacatagcttttattattaaacatttccaaaaatcaggctgggcgcagtggctcacaccagtaatcccagcactttgggaggctgaggtgggtggatcacctgaggtcaggagttcgaaaccaggctggccaacatggtgaaaccccgtttctactaaaaatacaaaaattagctgggcttggtggtgggtgcctgtaatcccggctacttggtaggctgaggcaggagaatctcttgaacctgggaggcagaggttgcagtgagccaagattgagccatagcactccagcctgggtgacaagagcaaaactccgtctttaaaaaaaaaaaaaaatttaaagaaaatcatagaaaatgctgagaggtgagaaggaccggatactttataagatcctcctaatcttcacagcttataatcttgccattaaatcagaaacattatgggggaagttcaagagtgtggaactttaaaaaatgtttggcttgtttgagtacatgagaaattagtataaatatttaccatatagtgattgtcaaacaatgggatttacttattgttacactttatgggagaaaatgaaaatctcttcaagtaaagtttatatacatacaaaatcctcccctggatgtttgctttggttttaatgggatgtttcagtttgcaaatactggtaagcagagttgtttaaagttggaacttggataaaggtcattttagcagagcagccacacctctgctctgatactggaagaaccagcataaaattgctacagtggcataagtcaatgcaagattatgaagcaattaactagcaggttgtgtcgtaaaactctgttcacacttttagtacaggggtaaaagaggtcaatattgtttttcttattttataaattgaaaaacataaacctgcaatacgttgctctgactttaataatttgaccagttggaattagaatgtgttggagttacatgctgcaacatttaaccaagccttagatttctgattaaatattttaaatatataatagatacagaattaaccttcacacactctgatagctcaaatctctcactatgatattggtgtgataatgaattaaaataaaaattataggttaaaataaatttaaattaaattaaattgacaagttctatgtaggttcagagaaagagaccaaatccttctccttgagtaatttcagtgcttatatggaatataagggatgccaacattaggcaacgattttcaggatactttcctctttcaacttacacctagagttgtaaaaaatccttcatgtaggtgacacattgagattcagatcctaagaggatatggcataattgttctccttttaaaaatttcattttgagggctaacatgctgttttctcttatttttagttgacacatgatcattgtacatactcataggatatagagtgatatttcattacatgcatacaatgtataatgatcatatcgggctagtttgaatatccattgcctcaaacgattatcatttctctgtgttatgaacattcaaaatcctctcttctagctttttgagagtatacaataaatgatagttaaccatatttatcctacagtgctacaaaacaccggaactcatttcttctatctagctgtaattctgtatctattaaccaacttctcatcatcctcggttcctctttgccctttccaggctctaatgctaagggccaaatcttcatataaaaaatagttgtgaagaaaagaaagttggccaaaccaggatcacggccgtaatcccagcactttgggagactgaggcaggaggatcatttgaggccaggagttcgtgaccagcctgggtaacatagtgagacccccatctctacaacaacaacaacaaaaaaaaaaaaaaaaaagaaagaaaaaagaaaaaaaaatagccatgtgccacgcacctaaagtctcagctacttagaaggctgaagctagagaatctcttgagcccaggtgttggaagctgcagtgagctgtgattgcactattgcactcagcctgggtgacagagtgagactctgtctcaaaaaaaaaaaagaaaaaaaaaaaagaaagagtttgtaattttttaaagttaagaaatagaattgaagaggctgagcagtatctggaaacaaaaatccacttaaaaacactcatgtagctaatgccattccctagattcatgagggcttttttctgctgaaactctcgaggaatgaagcgtttctgggacatgagcagggagaatgcatataaccctcagagctgagatcatgcacctccgactcttcctccttgtccagtgttgactaacgtggtctactggattctggtccagccatgttaattaaggtgacaatacaaatgaagttcaaacttccctaacacacgaagctaagaaatcacaaaatggaaaagtctgaaaggtctcaaaactggagccagtctgtagagctggggaagatgatgtgcttattggactcaacccaagagactagttccaaaggagggagacctggaaagagaaagaggttactgtgttggcatggctaaaggatttaattagaatctctcattaaaattaaccacatttcacagacttcagtcggcaagaatattggaaaatgatgcacaaggctgggaaaaaaatgatccgtggtgctggatccatgatctacttggaattagtgtaaaaagtgagatgaacttcactagggctaaatctcctgcttgtgggtaagaaaataaccaatttcttttcattcattcttaaagaccaaacatgcttaaaacaaatattgcctttccccctctaatgttcattctgtactggaagtattctctttgctatttctttaaagttttagtgtagccccttgggtccagtttcagtcaatcaaataagaaaaatattagtaccactcccagccacttgagctaatgcattgaatcaataatctgtttcaatttatattatgtaacatacattattatatatttatattaaaaaatttagtccagtccaacatagtgttccttcctttctgatccaacatccttattgggcttccacacatgtccttctggtttctgttgatataaattggtgtattataatcttacggcttatatttcatacctgttggggcctgctgggatttgtgtctgttctagaatcaatgagaaacgggtgggggtggggctgaccctgacccactgctcctcctaaggagggtcagaagtcctttgtaaggcaaccacttcagaagagaccattgcaggaccttcagccatgaggacaataatctccttaaccaggctaaaaagggctgcttctaccagcaaagaagacttggcagatctggggacttcaggccccctgccacatcgaatatgcctacatactcccttcccaatttttatgagtccctctcctttccaatcattgccttaactttagcaaaggagatcctgtaaggttaaattcaattgaattgaactttgggtttggttttcagaaatcttgactctagctacaagaaaagatgctttttttggcgagggggagggcagtcatagaagatttctagtcctttagccagaccttgagttgggaatttaaagccctaagctcatcattttctttctccaagtgctgcagaacacttcaaaatcagcaagcaaccccattatgtgtaaagtgttctatggcaggagctacacatagtcacctgaagccttgcttgctttttttttttttgagagggaatctcactctgtcacccaggctggagtgcagtggcgagatcttggctcactgcaacctccgcctcctgggttcaagctattctcctgcttcagcctccggagtagctgggagtacagacacccaccgtcatgtccagctactttttgtatttttgtagagatgggtttcaccatgttggccaggctggtcttgaactcctgacctcagatgatccgcccgccctggcctcccaaagtgctgggattccaggcgtgagccgctgcgccaggcctgaagccttgctgtctataggcacttgatgacaggtctctataggtaaatcattaaaatcacttttgccatcttgtttcatacatgaccgttaccctctttaccgatggaaacagaatcactaacactttaaaattgaatcagatcagagaaccaatttcaggtagcctagaactggttccaaggacacatcctctgaaacgatttctggcacgggtttccatagaaggcagggttcagtcagagatgctgaatcactgtaagtggtacggaataatggattcattttggggattagacgttacacaattgtgggagttgctggaggagtcagtgcaaggctgttgcgtcttcgtctggtgatgaaatccttgtaggttactagacccacttggggaagaaaagccaggtatgaaatggcatcagcaaggacagactgtgacccactagaacacactggaacccacaaggataactgggacccacaagaacaaactggaacctgtgtctgcctcactggctccaacatggtgacactgaccaggaggagatgtggagcctccttcatcgaggagctgcacacacacctggcctgggacgcagaggagctgcagggatgttctggtgggaactggagaaggaggagcctggctggtggccacgggacaggatgtgcttgcacattaatgacaacgtgtgtggctcccacactgcccagagcctgcactgaccttcagaacctaaagatatggcagagcccttgcttttgtctcccaaatattgggcaaaattctcttgtggtctgccctaacccagcaacatgcagggaagagaatgctggaaatgcagtcccagcttggctaagttgaccaaagcagcaaacaatcagtatttcctattgtcatggggtttatattctagtgaggaaagggactatcaataagtgagtaaatatgtacgtgtgtatgtgtatttcttataagaaccttctgagataggaatgtgtcttatccctatttgacagatgagaaaactaaggccaaaatcgattaagtattttgccctaggtcctgtagctcataagtgtcagagcaaagctctggacaaggcagtttgcaatcaaattccaatgtatactaattgctattctgttttgttcattctgcagtagccttccccaaacactcaacccaaatgggatactttcaggtgatattgcagatgttattagtttattgcattcatactattttatccttcaattgtgttgtacttattaataatgacttacctaattggatataaaactctttgatcgacaatatgaacatgtgtgtgtgtgttcacttcggctgttaatagtgttgcgcactcagccagcgccttgtaaattcttgttgtgttgacttaagggcttgaacaatcacacagcgaggcatgtgtacctgtggcctaagcagcattaagtttgaaagaaaccttttcctaagtgctttgccattctttgaaatgtgctgaagaaaagagaaagcagtcaccactccctccaggacctacctctgtactggcctcagatcatcacgtaattcagacaagctggggcacgggagcagtcgggaggacagaggggtcccgctgaggctggcccagtggcggtcacggtcgggtttgccacgaaggatccttccaaaggcctattaagtgaattcctgtagctcattcagccgatggaaggtagaagggactcagaacttcaggcctaattctgcgtttttgtatgccccaagaatgaaagggctctttgtgaatttgcatgtagatttatttaacattcaaccggcagaaaacggaaggtagtgcatgacactggggggaaccaggcccccgcccacctcacatcgtcatggcattagctgtttactggctcccgtggaaacattggaaggggatttgttttgtggttgggtttccttttttttttttttttagcatgattgcagttagatctgcagtatttcctcaaatatgtgaggggaagggagcggtgacttcctaaaggaaagtatttatatttttagactgaaataggctgttacaaagcttttctccaaaaacacatttaaaaaaggagtgttctaaacaatagaaaatgtatcttaacgcatagttaaggtagtttatcttataaaatatgttttaatgcagtgacaaagggctaagacactttggtttgtttttatttatttatttttattgatacatggcaattttgtcttattttaaaggagcaccaagaaaatgcttctggatgttggaatgtcagcctcgactccgcttctttctgaactcgcttgttctgcttcgggctcccatgtcagcagtgtcgtggagagctcgtccgtgtgaagggacagcatcccggccaggccatggatggtggcccgggaggaggaagtgtgagcgggtcaagagagagagaaggcatgagagaggcactctgctcggatgacacagcccacactgttttgccacagatttgtggtgtatcacagctcgagggagtcctggaggccacccaggccagggtttctcatgttgttgaccatgtgcaccaggaggtgaggcctgggaatccacctacttagtggctcaggagagctggcccaataaccagctggtacagaggcctcatttcatcgaggagcagtctggactggagaggccacaggactcggaacagcaccagattgaaagcagagcccatttgagacgtggcttaaagagggacaccatgctgtccaaacgtgggtgtagacagagcagacacagcctcttttatctgcttattgtggctctgggaagacagctccccaacccctccattcctctctcatttgttcatcttgaaacccattaagagggcacaaaacctttatgtcacagtgggagataatatgtgaatgattcttagaaaggtaagaggtataggctgggcgcggtggctcacgcctggaatcccagcactttaggaggccaaggtgggcggatcatgaggtcaggagatcgagaccatcctggctaacacggtgaaaccccgtctctactacaaatacaaaaaaattagccgggcatggtggcgggcgcctgtagtcccagctactcgggaggctgaggctggagaatggagtgaacccgggaggcggagcttgcagtgagccgagattgcgccactgcactccagcctgggcaacagagcgaaactccgtctcaaaaaaaaaaaaaaaaaaagaaagaaaaaaaagaaaggtaagaggtataaaatatcccccaagctaaggaggcgctgtaataggcagctctccacttttgagaagattagctattggaggaagaggtggcatgaaacggcacaggacccaaaaggtgccctgcatggagggaacatcccagatcacagatcaaagactggatgcagggtgggaatcctgttttctaattttttattataaaaatttccaaacacacaaaaattaaaagaatgatgtactgatcacccagatatctaccacttatattcaaaaacttaaaacattcccatagatgtgcatgatctatctataggtccatctgtgtgtgtgtgtgtgtgtgtgtgtgtgtgtgtgtgtgtgtgtgtgtgtgtgtgtctggtcgaggaccagcatttcaataaaggatagggagtgctcaacaggaaacaaggacaagacacagaggctgaggtgggcagatcacttggggccgatagttcgagaccaggctgaccaacatggtgaaaccccgtctctactaaaattacaaaaaaattagctgggcgtggtagcgcatgcctgtaatcccggctacttgggaggctgaggcaggaggatcgcttgaacatgggaggcggaggttgcagtgagttgagatcgcgcacttcactctcgcaacagagcgagactccatctcaaaaaaaagaaagaaagaaacttagttacaaagatttgaactttaacttgatgtagttaagtttaaatgtatgtggaataaaccgtggcagggtttgatttaattttaattgttttttgcttttgtcttatttagagaggtaaatgagatgctttggcaactgttgaggaagagaggaaacagacttcaatgcagttaagatggacataagcaggttggaaggcagccagagggaatttttgcagaaggagtgacccagtcttggggacagagaatatggatttgttttccccaaagaatttattgagctctgtgtgtagtgagcatggctggatggtgtgaagagcaggtggaggaggatatcagggacaagagacgaatatgggtggcgtggccgcagcactgcacagggccagccaatgagctagggctccatgcatagcctgggcaggactcttccagtatctaaaggaagaggtttacatttccagaagtgttaacctgtgtcctctcagtgtctgcccagggtaacccatcttgataagatatagtcatttctccttttggcccaaggaacaagtccaggctcatcggtgtggcaaaacctgaccatgtgcataccatgcacccggcagtcgcactagctgctcagagatgcctaaatgcaccagggcctttttttaacttttatttttttttttatttttgagacagtcgtctcgctctgtcacccaggctggagtgttaacgcgatcttggctcactgcaacctttgcctcccggatttaagtcgattctcctgcctcagcctcccgagtagctgggattataggcgcacaccactacacctgggtgatttttgtatttttagtagagactgggtttcaccatgttggccaggctggtctcgaactcctgacctcaggtgatccacccacctcggcctcccaaaatgctgggactacaggcgtgagccgcgcccggcctgcaccagggctgtttattccttggacactctgaaggtcagctctcttgacctcttcccaatcatgtctagcctgcagtgtctgactcagttttcaagaaccatctcaaatgcaagtcttccttaacttccattcataattaataatttcctttggtttccagagtagttggtcttcacactttttggtcaaataacctttaaaattattttggaaaactgtttcacctcttgcagataattaagttgacactcccaatattcttaaagtttaagtagttgtataggatttgatttccagagtattgtaaaagtattccagatagtttacaaatacagcaattgtatttctcttttaaatgtatcactggaatagaaatagcattgcaatgtgatgtctacttcagttattttttaaaaagtacaagaccaagtttatccttaacgggagtagaatgaagatgagagggagtggggagagcatcgtggttggtgggtttcagaaagaagagccctggtctgcttctctgatcagggttcggggcagcagcaagcccagacccaagtccatgtatcagagggcagggaggatttttgctcccaaggggatcaccagattcccgagaagaaatggctgtcagatgggtcttagtagcaaagagcttcctgcacctcagcgtgtcatggaaacagcagaataattcttgtgtacccatgagggccccaggagtcataggagaagagcctcaaaacctggaggagccagtggattgaaagggacactgtctctgtgatgacctgtgtagaccagagaccaagggcctggcagggaaacacatgtctaagctgatgtctgtgtggacaggtgacagtgagggcctggtggattctcctttgcttcaggataccttggcatgacccctctaccccaccgaaaacctaagtacaaccccagacaaagggcagaatggcctagcgtggtggctcatgcctgtaatcccagcactttgggaggccgaggcgggtggatcacctgaagtcaggagttcgagaccagcctgaccaacatggtgaaaccctgtctctaccaaaaatacacaattagctaggcatggtggtgtgtgcttgtaatcccagctactctggaggctgaggcaagacagttgcttcaacccaggaggcagaggttgcggtgagctgagatcatgccattgcactccagcctgggtgacaagagcgaaactccttcttgggggggaaaaaaaggcagaatgagatgtcatttctatcactctgatgtaatggtgacggtgtaatggtggcttgaaagataaaacaattgagttaaagaaaaataaagctgtattttgtacatatcccagtgtgcaagataaaagcatacagagatgtagtcctgctacaaatgtgtagaacactttatttttgctcctctaattagaccatatactcctatgatggggattgtatctgctttacattaagtgtattgcacaccagtgtttgtgaacagaggtgtgtatgtgtgcgtgtgtgtgtgtgtgatgttactgtgactgtggtatatgaagaactgtcttgattcaggacaactcagccaatatttctgacgttagatttgatcaatttttgcctttttggggtctaactttggaatcacacttaaaactccctcatgaatgttgggaagaagtatttttgctgaggaaaaactgaactcacagagcaaaatgtaaagaaaaaatggaaattgagaaggtagtaaaatactaatgaaaggaaggaaattgtggaaagagttgctgtcagctggggactcaaaaggaaggaacaggtcggttcaaggtcatagggtcatcagagaggagtgcagactggcctccaaccaagcacagggcaggagcctaaggtcctcagaattaaatttatttcataaatggtgttcaaatccaattaagtaggtccagatttacagtgatttcaagtgaagcttttaactgaaacctgaggcctgaaagtgggtttactcctgtgcttttggttaaagcaagaatcgttagttagacaaagcaaagcaacagtaaagcaattttatgtttttgaaatcctcgggcaggtgagcttgttctgcctaagggtaaaccagcctctaccacttgttctctcaagttacgggctttgagggagccctgtgaaaaattgccgtgtaatggatctgtactgaggtggttgactgataaggtgctttgtgttagaaaggtgcctgggcaatgtaaacataacgacaaggagctctcacaggcttcatgttcaaatctcgtgggggaaagagatgctggaagagcttcctccatcgggagaggtgaggttgccacctggttcccaagtcataggaatctggtgctatcttagactcactcacaggagctaatggtagttttgcaaatgtgtcgattgggaaatgctacaaaaagcggtttctagggggaacattttctctgtattgtaaatgatacaaaaattggatagtgtggggcacagtagctcacacctgtaatcccagggactcaggagactgaggtgggaggatcacttgagcccaggagtctgagtcttcagtgaactctgatcacaccatcgcactccagcatctgcaagagagccagaccctgtctctaaaaaaaaaaacattagatggcaaggtcagaaaacattaaataaatttatttaagttctatataaggttgttattataatgatcacattaagggcaggtgaattggtgtacagctatattgaagtcaataatctgagcaccaaaatgatcagaaaatgtagagtatttctataataaatgaggatttatatgttctaaataatcagttatttcctccaagggaagatccatattagttgaacatttcagtaattctccgaacatggacagcaatttgtttctgcccattccagtaggagaaacactggcttgaggattttacaatgaatgtgtacagcaatttttgtgtttggtattgtggccactgtatagggtggatttattgccgccttccacttgcatataatccacaggaggtctcttcagagccagttccttttttttttttttttttttgagacggagtctggctctgtcgcccaggctggagtacagtggcgcgatctcggctcactgcaagctccgcctcccgggttcacgccattctcctgaatcagcctccggagtagctgggactacaagtagaggggactacaggcgcctgccaacatgcccggctaattttttgtatttttagtagagatgggttttcaccatgttagccaggatggtctcgatctcctgacctcatgatccgcccgcttcggcctcccaaactgctgggattacaggcatgagccacagtgcccggcccagagccagttccttttataatgacacgtgcctgagactctcctgtccctggtctgtctggtggactgagtcacccctaaagaccactttgtagtcatagaacatcatctgtccccagtcaacacatttatttatctattttctgaataatcaggtccaaattcctctacctggcttccaagaccttctgtggtatagcgccaatggaattcctgggtttgagtcacatttcagaacatgttagctaaggcctataccttgccaggtgcttgtgtgtgggtgggtctatgtacaggtcataaagataccatgcagggagattgagctccaacactacaagctcatctcctcatcaacccagctgcaaactgtgttactacttcctgtatttccttcaagcaaaatatcttgccatttccatactgctattcatatccctcagggtccaatgtctctgttcatttaggctgccataacagaatcccagacatgaacaacagacaattacttctcacggttctggaggctgggaagtccaagagcaaggtgctggcagattcagtgtctgatgaggcccctctccttagtttatagtccagaaagccttctcactctgtcctcacatggtggaaggagtgagggatttttctagagtctcttttataagggcactaatcccatttataaggggctctgcccccatgacctaatcacctcccaaaagccccacctcccaatgctattgcattggaagctaggaattcaacatgtgaattctggggggacacaaacattcagaccacaggacccagcaaatgtttcttgttctggctactttagtcctccctgttttttgcgctgaaatttcacggtaatgatactgggctgggtgcagtggctcacacctgtaatcccagcactttgggagtctaaggtaggaggatcacttgagcccagaggttcgaaaccagcctgggcaacacagtgagacactgttcctacaaaaaaaatttaaaaattaaccgggggtggttgcggactcctgtggtcctagctactcgggaggctgaggtgggaggatcacttgagcccaggagattgaggctgcagtgagctgagattgtgccactgcactccagcctggtgacagagtgagaccctatctcaaaaacaaaacaacaaaacaaacaaaaaactccaaagtaacaatactctcttccacacagttaaggccatatcattattttaaattttggcttttatttcaggtatgtaggtctcatgtctcccacctacactgtaaattccttttttcagcctagctggacactcgttaaacatttgtttggtgagtgataatggaagactcccatttaaacaaacaacaacaataacaacagcaaaaacctcgctcccctgactgataaaggagcacatcatcctcttctctactgaagtttggggaagacgtagtcagccaaacatctttatctctgactctactgactttcccacttttaagtgctggaaccaggacccaaacttagcttttccgactccacgttcagtgttctttctgggacagtacgtgtaagagaacaaaagcctgggtcctcacagccttccaaagttactaaccatatgaatggaaacgtacaatggatgacattatttcttccaggatgtaagaggttgccaactgtcccgctgctcttttcagaaggaagaagacattaactatttactcccagaacacctgggactgggtaagggaagagagtgatgaatggcttatgagtagatgccccagagatggggaagtagagtgtggctaattccagcagcattttgctcaggcattccctgaatcccacagccaacgtccatctttcccagcctcacaagaggcagtagtcaggagcacagactatggagtctgcccaccttggtttggatccaagtgcctccttctagaagctctgtggccttgggcaagtaacttcccctttctgagcctcagtttcccatctctaggaaatctacaacattataggcttcctggcagggctgctctgaaaattatgagttaatatctgtcaagtgctgagagagtgcctggctcataacaaatactatgtcatgtttcttaagaaacaaaaagcaaagaacttattatttgtggagtttgtttctcacaaaggcacattatgctatcatggaatttgctgctttcattcaacatgtgttttgagatatattcactatactacaaacagatctagttctttccttgtgactgctctatagcattacattgtggaaatgtattttatttggccatttgaatacaaatgggcatttagattgtttctattttttgttagagaatcagtattcaataatactctcatctattaagtcaaatattttctattgtaagtatgcattttattgtaagtaaggcttattttaaaaatgcttagctatgtaaagtcacagatctaatattatatttagtcatgaataaatgttttaaaattatgtatgagaacattaattaggaaaatgttgctacattactttcaaaataagcatatgttttaaacaaacgtggttttggggagaatatatcatatagatgcatctgaatgctgaagcatcactaaatccctagcaaatgcattttttgggaataatctttttagattaagtagtattttatatatatattttgagacagagtctcactgtgtcacccagactggagtgcagtggtgcgatgttggctcactgcagcctccgtctcctgggttcaagcgattctcctgcctccacctcccaagcagctgggattacaggggcctgccgctgcactctgataattttcgtattttttgtagagaaaggatttcaccatgttggccaggcttgtgtcaaactcctggcctcaaatgatctgcccgcctcggcctcccaaagtcctgggattatagatgtgagccaccacgcctggctagtttttgtatttttagtagagatgaagtttcaccatgttggccagactggtctcgaactcctggcctcaagtggtctgccagcctcgacctcccaaagtgttgggattatgggtgtgagccaccatgcctggcctaatgttatataattttaatgcaatcttaaattctttgttttctaatatctactttaaagttttctttttgttcttgagtccatacttggtgatgaattccatttttagagacttaagagaaggttttcatcaatatgacacaagcacatactcttacagtcaaatctttatgtcatgtaggacacacctactatatctttgtctgaactcctcacagtgaaagaaataggtacatatcctacatgcattctattacgtgtaatattatttattaacttttaggttagttttgatttttttgagtgtgtgtatacatttgtgggctgtttttcatccccaaagtaacacttgctcatttttaaatattaaaaaaaaattgagagcaggataaaataaaataaaatatcaaatccctttccagtgcttcccaattttactcaccaatggttgctccaagtaactgcttggagcttggcaggaaacagacggcactcacaaaaggggtgatggaagcaggtttcatgaagggactacttacaaaggaggggcagagctaagagaaactaacaaggggcagtgaagcaccctggggtggccatagcagcaagttctgtaccctctcctaggcctgaaggaacaagggaagggagtggatactcacccagcaagaccaaccagtgtagaaaaggtccctggagagcagcccagccctggggagaggaaccccgctactgcccaccctgaggcctgactaggaagagtgaggaaaagtacaccatttcctctcctcccggcctcccagctcctgccaatttctcccatcagctaggtccagccggaagtcagagggcaagagggcctgttggcgcatcccatggcagcctgcctcctgatggggcgcaggaaagaaaggggtggggcagggatctggaggggagctaaagaaaattcaggcagggggcttacccacagagtcagtgacaccagcctctgatagcttcttcccacaccacatgcattggcagatttctctgactttctttttagggcagtgtcaccctcccatgcattggatgatccttaaagaaaaggactggcagacgggatctgagcctgggatccgagcttcccaaatcgtttgagcctctagccagggtgccacaaaaggggagatctgagcaacagacatggccggtgctaacgttgtaatatttagagtctgactcatcaaatccaggtggtaatccctcagatccttgggccaccaagcagattcacgaaagagcacttacctcttcattaaggcttgacaacacatttcctttctgagaatacaatgcttgggctggtctgatcatattcagaaccacaaaattgcttttgtttagctgtaatcccttccccaacttgtaccatcttgaaacattagtggagatactaggaaactgtacatcaagtttttggcctgttccaaagtttttggccataagatgctgaattatatcaaaattgtgaccaactaagtttggatttactttcaatatattgttatttaatgttacccatggagttgattaggaaagacatcaaaaggtcagtgatttacaaaacactatggttgagtcctaggagttagaaggagagcagtgcaccaacacagagattcaactctaggagaaaacatcagtcccagctgtggctagggtgacactgttgtctgcatcttcgctgaaaaggtaagtggaagcctggatgtccttgtctgtttagtgctgctgtaacaaaatatcagaaactgggtaatttacttcttaaatcaccacgtaaagaccccgcctcttaataccatcacactggccaccaagtttcaacacctgaattttggagggaacatgttaaaatcatagcactgggcttaggagaggattcaggaaagtgattggagcaacatggaagtaaattcattgtcatatgttcttagcttagagtctatactttcttttcttttcttttcttttttttttttagtttttttgggagatggagtcttgctctgttgcccaggctggagtgcagtggtgcgatcttggctcactgcaacctctgcctcctgggttcaagcgattctcctgcctcagcctcccgagtagctgggattacaggcatccaccaccacacctggctaatttttgtatttttagtagagaagggtttcaccatgttgtccgggcttgtcttgaactcctgacctcaggtgatccaccggcctcagcctcccaaactgccgagattacaggcatgagccactgtacctggcctagagtctatactttcagctgcgtagtgactagcagatttgaataaaagataatcctgaacatcttgcaattgctgcaacctaaagcaatataactagagcttttctaaacttctgtgcattttgcccactctccttgacatggccctcaagccagccagccccttctcggggcttagttcctcagttctctctctgtggtcctattagtgacaacggcagacaggctgtctccagcacaaatggagaactacctgccacatgtccagacactcaacagttttagtgcaaaccaaccgttacaatatgttctgcaaacatactttatcttaattttgttttttatcagttttattgaggtataatctacagagcataacatacatctcttttaagtatacacttcaaagaattttagcatatttacagagttgtacaattattaccatgatctaatttcagaacatttccatgaccctacaaagaaacctcttgctcattagcagtcattcccaattttcacccccagctgtaggcaaccactcacctgttctctgtttctacagatttgccttttctggacatttcatataaataggatgataaaatctgtggtcacttgtgtctggcttgcttcactgagcattaggttcttccagtttttagtgtgttttagcccttcattcttcttgattgtcaaatagtattccattgtgtgcataaacatcttgttttccatttatcagttcatggacacatagattgtttccactttttggctactgtgaatagagctttttttttttttttttctttgaaacagagtctcactctgtcccccaggctggagtacagtggcccaatctccgctcactgcaacctccgcctcctgggttcaaatgattctcctacctcagcctcccaagtagatgggattacaggcatgtgccactagacttggctaattttttttatttttttagtagagacagggtttcaccatgttggccaggctggtctctaactcaggtgatctgcccgcctcggcctcccaaaatgctgggattgcaggagtgagccaccacaccctgccaaacattgtttacgagtctttgcatggacatatgttttcatttcatttcctttcttttgggtagatagctattgatacaagcggaattgctggatcacatatgaagtctgtgtttcaccttttgagaaactactaaactgttccagagtggctgtaccatcctccatttccacaaacaatgtcggagggtttccgtttctccacatccttgccaacacttattatcgtttgcctttttaaaaaattgtaactgttctactaggtaaaaaatggtatctcattgtgattttgtcagtatgcgtttccttagtgacgaatgatggtgagcatcttttcatgcgcattttggccacgtgtatatcttggggaaaatgtttacttaaatcttttgcatttttttaaattaaaaattttattgaggtaattgtaaacccatgcaggtgtaagaaataattcagagagatcccttgcccaatttcttccaatgatgacatactatatcatatcacagccaagatactaacaatgaaacaatctaccaggcttactcttgattctcctgtttcacttgtactcttttgtgtgtgtgtgcacatatgtgtatttagttctgtgcatttttttttttgagacagagtctccctctgtcacccaggttacagtgcagtggcgtcatctcggctcactgcaacctccgcctcccgggttcaagggattctcctgcctcagcctcctgagtagagacaccaccgtgcccggctaattttcgtatttttagtagagacggggtttcaccgtgttggccatggttggccaggctggtgttgaactcctgacctcaggtggtctgccccgcattggcctcccagagtgctgggattacaggcgctagctactatgcccggctgagttctgtgcattttttatcactgataaaggtatgtgtatctgttaccacaagatgcagaacaggtttgtctccataagggtccctcctgttgacttttataaccataccatctacctgccccacttggctccactccattacacctcctcccactccactgctcctaaccttaggcaaccacaagtctgctttccatttctataattttgtcatttcgagaatgtcatataaatggaatcatgaagtatgtaatctgagattggttttttttctgttagcataattccctggaaattcatccaagatgttcatgtatcaatactccatatcttttgattgctgagtatttcatggtagaatgttctacagtttatttaaccattcacccactgaagggtatctgagttggaaggacatctgaactgtttccaggttttgacaattgtgcatgaagcttctatgaacagtcatatgcaggtttttgtgtgaacagaagttttatttctctgagataaatgcccaagagtgcaactgttcagtcatatagtaattgcatgtttagtttcataagaaattgtcaaactttctcagagtggctttaccattttaagtttcctccagcaatgtatgagtgatcgatttctctgcacccttgccagcatttgatgctgtcactattttttattagtcatttgcatagacgtataatgatacaatagctttttgtgatttgaatttgcatttccttgatggctatgatattgaacttcttttcatgtgcttgtttggtatctgtgtctcctcttcaatgaaatgtctgttttggcttatgccaattttctaattgagctacatttttttttttttttttttttttttgagagggagtctcactctgtcacccaggctggagtgcagtggtgcgatcttggctcgctggaacctctgcctcccatgttcaagagattcttgtgcctcagcctcccgagtagctgggactacaggtgcacacaccaccacgaccggctgatttttgcatttttagtagagacggggtttcagtatgttgcccaggctgatatttaactcctgagctcaagcgatctgcttgcctcagcctcccaaattgctgagattacaggtgtgagccactgtgccaagccataatggagctacttatcttttaaccattgagttttaagagttcttgatataatctggatgcaagttttttaaatcacatacatgatttgcaaatatcttctcccaatatttgagtgtatttttactttcttgatggtgtcttttgacatacaaaagcttttaattttgattaagtctaagttaccatttttctcctcttgcatgtgtttctggtattatatctaagaaatcattgcctaacccaagagcatgaagatttactcctattccttcttctatgatttttagtttcagctctcacatttaggtctgtgataaattttgagttaacttttgtgtatggtgtaaggtgcttttgcttataaatatccaattttcccagtactatttgttaaaaataccttctttctccttacattttgttggcacctttattgcaaatcagttgaccataagtggaagcacctatttctgggctctcagtttttttttttttaaaccattgatcgatgcgtctggtaccacactgtcttcatccctgtagtctatctttttattttaacaaatatactgctatgatcttctgtaaatgcagattctaatttacaattttttgattccttggagttctgccttagaatattcagaggcagccccatgcttccagcctgcctgggcctttctccttctcttccaactcccagctctgtctcattgtgttaggagcctcctgtgcacatgttaggcaccctaaccctcagtcacaggatgacagttttatttcttttctgttttttgttgttgttgtttgtttttgtttttgtttttgagatggagtcttgctctgttgccaaggctggagtgcaatggcgtgatcttggctcactgcaacctccacctcccgggatcaagcgattctcctgcctcagccccctgagtagttgggattgcaggcgcccgccaccaagcccggctaatttttgtatttttagtagagatggggtttcaccatgttggccagactggtctcgaacccctgacctcaggtgatctgcccaacctcagcctctcgaagtgctgggattacaggcatgagtcactgtgcccagacagctttatttctttaaatacttgtcagctgggactatccttatgctcctagaggccttcctctgattcttgcagaaggacttttatgttttggagtcagcaaaaaatgcattagatccttgtcacccttgaaatctgtccagcttcccctcctgccacatctctcttctgccttcagctagaagaagactctgcttgtgaagactcatgtggttatatcgggtccgcccagataattcaggataatctccctattttaaggtcaattgattagtaacattaattacatcttcaaagcccctttttcccgggcacagtggctcacacctgtaatcccagcaccatgggagattgaggcaggtggatcacttgaggtcaggagtttcagaccagcctggccaacatgatgaaaccctgtatctactaaaagcacaaaaattagctgggcgttgtggcaggcgcctgtaatcccagctacttgggaggctgaggcaagagaatcgcttgaacccggaaggtggaggttgccgtgagctgagatcgagccactgcactccagactgggtgacaaagtgagagtccatcttaaaaaataaaataaaataaaataaaaaaggtcctttttttcccatgtaatagaccatattcacaggttccagagattagggcatggacatttgtggagggccattattcagcttgccacactagacctagaattattaaattagtgctgtgattttgatcttctgaaagcactttgagttcaccttcattttaggagattattgtcactggctgtgagttctagcttttaaaaagatattccattgtcttctagctccatcatttctaccaaaaagcagacaaaatgtcttactgttacgcctttgaaggtaatgtttccccccacgctctatccccacccaactactttaagatcttcttttcatttttggttttcaacagctttatcttgatgtgtgtatgtgtgatttttttgtgtgcagagcttcttacatctgtgagataatgttacatatcagttttggaaaattctgcttggttatttggttatctcttcaaatatttattctgccccattctcaaagagctttaattattcctgtgtattacacagttccaatatataccaggggtttctgtgcttttttttcattgttgttttcctttgtgttttaaaatctgaatatttcctactgacctgtgtgtcagttcaccagccctttcttatactgtgcattgtctagtcttgaacccacctgctgagtcctaattacagacattgtactttccattttacagtttcatttaattttcctctttaggttttggtttttctggtaataatctctactgtttgttttcctctatttttcttgaacatatgttagttattttagagtctctgctctgagtctgcgtctggtatatatttcattccctcagggactcaacagactccatatagtccttttccctggtaggccttgtaatttttaactgaattctggacattgtctataaaatattggagagggctgggcacggtgactcatgcctgcaatcccagcactttcggaggccgaggctggtggatcaccagaggtcaagagtttgagaccagcctggccaacatggtgaaacctcgtctttactaaacctcgtctttactaaaaatacaaaatttagctgggtgcggtggcgggtgcctgtaatcccagctactcaggaggctgaggcaggagaatcgcttgaacccgggaggcagaggttgcggtgagccgagatcgcgccactgcactccagcctgggtgacagagtgagactctgtctcaaacaaaacaaaacaaaacaaaacaaaactggagaggcccagttgatgctactttcctccagggaaacgttacccctccccttgctaagcagctagagtcgggggggtactgagcttttgcttttgctcagtaagggactgagcagacgctactctgggttgcagtcttggcatagctctctttggttcacctctcttcttacgctaatgagttctgggctttcaactgaggacctgatgtgtacactggggttcctgtccctggcaggtcatgaactctaatctttgtcttatcattactctgaggctgccaaaagcttggctctagttttcagctgagttatttatttccgtatcctttccagctgtcttgaagagaaaacagtccatgtttgaggcccttcaattgtgtcactccagctgcataaaagtgccaaaaagtctactggtttctccgcccatcagaagcagcgctttactcaggcaaagcctgggctttcagcctcttgctcatacttaggattaagcaatttcctttgggaaaagtggctgcagaaggttggatcattacttcatggctcttctctctgaaagtttattaccctttttccttgttgctttagaaactatgtgatgtctgtaagcagatcatgcttatgtttaatctagcttttctagttgttcctggaagaatcactggtcttacataagcaactctaccctacccagaaacataaggccagtgagtgctagaggtgttatttctgatatatatcatttttatgtgggtgtaatgagaaatttttagagtatatagtgtgctttactgtcagaaatgaacgccttccatttccacttttttcttggtaatgagtatgttttctgttaaaacatagtgttttttttttaaactatgtatatattttattccgatgtgaagtacaattttagacatggagtgcttatccaattccttttccaattatatttatacctttcaaaatatttaaacaggataaataggataaattaaaaatgatgaggctgggtgcagtggctcacacctgtaatcccagcactttgggaagctgaagtgggcagatgacttgaggtcaggagttcgagactagcctggccaacatggtgaaaccccgtctctactaaaaatacaaaaattagccaggtgtgaggtagtgtgcctataatcccagctactcgagaggctgaggcaggagaatcacttgaacccaagaggcggagtttgcagtgaactgagattctggcactgcactccagcctgggtgactgagcaagactctgtctcaaaaaaaaaaaaaaaaaaaaagcgatgagctgagaagacaccaagatttgcaataactgttacagatggtagacaagtcttaattaacaagacaatctccatcaataatataaaaaagtgaacaaattacaaataaaactacttcaaatatattttgaaaaagtagacatctgtatttttccatctggaatacacaggatctagtcttctagataaatgtctaataacttcatcttggatcatcaggaaaaatcaattacatataatatttttctaaactctatggtcagtcacatctaaaatcattaagtgtaaaacagcatatgaatctaattacatttataactgaatgcccagtatagatgattttgaagttctactttttttttgagacggagtctcactctgtcacccaggctggagtgcagtggcgcaatctcggctcactgcaagcttcacctcctgagttcacgccattctccggccccagcctcctgagtagctgggactacaggtgcccaccaccacgctcggctaatttttttgtatttttagtagagacagggtttcaccgtattagccaggatggtctcgatctcctgacctcgtgatccgcctgcctcggcctcccaaagtgttgggatgacaggcgtgagccactgcacccggccctgaagttctactttttaataactagaacatgtaggccagccgcagtggctcaagcctgtcatccccgcactttggggggccaaggcgggcagatcacttgaggtccggagttcaagaccagcctggctaacatggtaaaatcctgtctttactaaaagtacaaaaattagtcaggtgtggtggcacacgcctataattccagctactcaggaagcagggacaggagaattgcttgaacttgggaggtggaggttacagtcagccgagattgtgccactgcattccggcttgggcaacagagcgagactctgtctcaaaaaaaaaaaacaaaaacacagaacttgtattaagtcattattctttctcttatgagtgactgtgtttctgcctttttaaatgttttgatacctgcatgtttcagatagcagttatctgattagccatagcattttcctaaaactgcctatttttagctctggtccttttttttttttttttcctcttttccttttggaaacctgccatctacagagatctcagaggagggagagcctgttcactcgcgaatatgtatttcgggcaagatggcgggttcctggcaggttataatttccactgctggagacctcagacactgagtattcacttccttttttgagggagacaaaatcaagggtagaacttggcaattacattaaaaaaaatcaacagataacgaaccgctgctattccagtaagcagacaaacatgtctaaaaattatgtttattttaccatgtacctttgttactaatatcagctattgttatttcacatgaagtagcaagaaggtgtatctatgtccatctaaatacttatgaaaataatgacagtatagtgtgtgttgtagcagcagtttgtcatgttgtttttttctcaccacagccctcatggaggatgtcatttatgtgaaagacacagacgtgaaagacacaggctcatgagggtacggtgaaacacacaaatcctggcagggtagttgtaaaagtccaccccttctgttcttacttaataaagcctagcaatatgcaaaagaatgagagtaaaattattactggagaaactttgactctactctacctttaaaataaataaaaagaaatccatcccaaactgacactctagtgttaataaccattttcttatgacatacttcccaatgatagagactcagcagtggatcaagatctttagattggaaagagctatacataatgcatcaataccataccacaagtactcatctcccaagtgttagcccaatatcacccactgcaagctgtcctctcattcccaattcccttttacaatgagccactccttccattgacgcccctctctcctttctgctgctctgcagcatgtacatgtttctaccattccaccaattagtgtaacttcattttggggggatgacttgtctgtttctttttacaaactacaagctccctccaaacaagggccatgtcacatctatttctctttgtccagcagtcagctcactgcctagaatacaagagttgtctgatatgattgttgacgaatgggagcaatatttagtagcttcgaatcactcagtgttaaagcctgagacgtgcacgctcatgatatggatatccaatactgtcaacatttcataatttggtttggctggtggaatttttgttcaaataaaaatgaatttagcatgaaatttgggttgggtttacactaacaagcaggtaaagagtcaaatgttctaatggggaaagtattatgctagattggtctccactcttaattgctgctgtcgcaggtacaggaatggaacataagcaaacctctaatagaaactgaagacaaagagatatatgttttgcacactgctctttgaaatttggttttgaagtgggatgagcttctgccattgtagttgaaatgccagggccagtgctgtgtaagtagagaggggtcatggctgggggaattgtcaacagaggcattattcagaagcatctcaaaagccagttgcagttcaatgttaggccataggcgctttcactgatagtggtactattaaacttcctaccagaaaagatgaatccttttgggaaaatttagtgaggaatcagaatagatagagaagcttctaggagcattttgagccactttgagaaagtgtctcaggcagtcaaaaagtcttccccgtagggtagatcagtacaggatcttcactaaggtaagtgtctctggtaggctgtgggaagaagtgatgtatgggatgtgccttggcagtgttttcaatatcatattcattctcaaccacaagagatagccaatatcctcaaagtaagtgattcgcacgtgtgtggctacaataactagaccatcacgaactctttaaaaaacagtggaagggggtctcacagtatagctgttgagagcacaaactctgaaaccagactgcctgggcttgaactgtggcttggtgactgtcttagtccattcagtgttgctataacagaatacctgagactgagtcattcataaaggggagagttttatttagctcatggttctgcagtctgggaagtccaagggtgcagcctggcttctggcgagggctttcactctgcatcatgacttgacagagaaggtcaaaggggaagcagatacatgggaagacccaacaggaggaggaacctcactttgtaacagctgatctcatgggaatgaattcattcctgagagaactaatcccatcttgctggagaaagaattcactcactaccacgagaatgaaaccaagccattcatgagaaatctgcccccatgacccaaacacctcccactaggccccacctcccaataccaccacatttcaacatggcttttggtgaggacaaaaaacaaatccaaaccacagcagtgacttaacagtggaggtcctgcacatgttgcttaattctctttgaatcaattttcgtctgtaaaattaggatgacaagagtatctatcccatagggctgctgtgtggattaaataagtgaatatacataaagtacttagcacactgcatgacatataggaagcaccatataaatgctagctatttttattatttatctgggataagcagtagcagacacgtaattgaaggttcaacagttgatggattcctgcttgtaggtaaacatgtagtcgtaagcatgaaaaaaaatcactaatactgcataagagttatgacacaattaagtttgggttattattgaaagaatcctttagaaggcctgtaattagaataaatgatcacccccatggctatagaagttctgtggaaattctggcttcctactacagtaaggtttttattcttattttttttgagacagggttccatcctgtcactcagctgaagtgcagtggcatgatcatagctcactgtggcctcaacctcccaggctcaagtgatcctgcctcaaccttctgagtagctgggactacaggtgtgtgccaccatgcctgactcattttttctttcttaatgtagagacagggtctcatcatgttgcccaggctgatctcaaattcccgggctcaggtaaccctcccaccttggcctcccaacatgctgggattacaggcttgagccaggtttttatttttttaattttatctttttttatagatgggggtcttgctatgttgcccaggctggatttgaactcctgggctcaagcaatcatcctgctttagcctctgagtagctgggattacaggcatgtgccactgtacctgacaacagtaaggtttttttgtgcagacactgttgtttctgacatgtaaccaatcgctgcctggaattatgtactcatgagtctaacagaatacttgagactgagtcatttataaagaggagaggcttatttagctcatggttctgcggtctgggaagtccaagggcataacctggcttctgacgagggctttcacactgcatcatgacacagcagagaaggtaatctatctacaatactgtgctatcaaaataatatagaaggacattcttttttctttataaaagctgactctccatagatgcataatcagcatgtcattaaaatattattttctgcctggattcttataaattgtagttctacatgtagcatgcatatattataagaacaatggtgttacaattatctatttctatgtaatcaatcaccccaaaacatggtgatgtaaaaaggccaccattttattacgctcacaattctgtggatcaggaattcaggcagggcaaagtgggatggctcacctttgctacaaagttggaagtttcagctggggtggcttggatggccagatatgtctgggacagctcaactggggccatcagtctggggcctcagctcttccatagttggtgtcttctgtggctggaacgtctccttcactcatgtgtctggctcctgggttgggatggcaagagcagctggggattggccatcagcactctgtctgcacaccttctccatgtgactagcttgagcttcttcacaatatgatgaatacagggtagtagcacttgttacatggtggctggcttccatgaggcaggactgggaacgatgagaccttaggtctacagacagaactcatgcagtatcccttcagttctattctattggctaaagaaatcacggtgcctgcccagagtgaagcgagtggagagacggtttctacttcttgacggaagtgtggcaatatcatatcatagatatgcatgtgaacaggaggtattgtggcagagatctgtagaaaacagtagctgccacaaacagaaattccaaactggaggcacttaggcaggaatgcacctccctgactgatgattgtctgggcttctgttatagcacagtggacaatcagcaattgataaacttggccaagagcaagtttacaaggccgtctttccccagcaagaatggcaggcagttgactgcaggcagtggggagaagtgctgacaaagaatttcattcaccatgctctttaatcctgccccaaatcccactcatcttgaacttcaggattgagacaaccgaggcaaaagttttccccagagagtttgagatggctttgaggatttcttatgtgattagatattcaagcagttcttcatagtttttcctgaatgttttcaagtaaattggtgcatgcatttcttgggactaaagtaacactggtttatcatgttggttcttacattcctgtggaagctgcagtggatggtgacgaagcatgggtctgaattcatagatctagtttaaatcttggctttattcattgtgcgaccttgggcaaattacttaacatctgagaacctcagttccttcttggaaacttagaataataattgttccttcttactaattttataagaatgaggcattatatatatttgtatacccatatatatataacatgtctcattgtttttatttatatattttatacataatatgtaaatatataaaaatacgtaaatatatatatttatatatataaaatgcctcattcttacaaaatcagtaagaaggaacaattattattctaatgtttcatatatctatgggatcactgtagtcttggcaagttgggctacttctcatcctttgggctggagtacatgtccaccttttctgtgagggcttccctcaacatcctatctaaggtaggtcctccctgtttctgtctgtcccttcacctgtttgacatgctataactacactcaaggtcattcctttatgtggtgattgctccccttaaacccattatgttttcttgactggtttttatcttgtttttctaaatttgaaggaatgctcattcatcacagagcctgtcctagctcctggctactgctgcagcgggagataggggcaaagagagaagagactggggatggtataggtggggcagggaggggaaagagagggaaaggctgagaaagaaacagaagttatattcagaggcacattttggtgaactgacatggaggaaacaattgagtccatgaatggaagatactgtgagacaactgggagttgaggattattgaaaatgaaaatttgggccaggtgtggtggctcatgcctgtaatccctgcactttgggaggccgaggcagggggtcgcaaggtcaggagatcatcaccagcctggtcaatatggtgaaatcccgcctctattaaaaatacaaaaattagctgtgcgtggtggtgcttgcctgtaatcccagctactcaggaggctgaggcataagaatcacttgaactcaggagggggaggttgcagtgagtcaagatcatgccactgcactccagcctgggtgacagagtgagactccatctcaaaaaaaagagaatgaaaattcactgtgtcacttatctgaaaaatatgattgccattaagactatcttctgaaaaaaaaaaaaacacaataatatgaccacacatgaaaagttcttagcacattgcttgccgtatagtaagtaatcattaattggtaatgatgatgttaatgaggttgatagtaatgcaaatgatgacagcagtaagaaccaataaagaatcttcttttcttagtcccattgagttctgatggtagatcctctaagatagcccctcctgttgggaagatcaatagtttttgtgattgcgtgggtgccaagagcttgctatctctatgtgagggagatcatttctattagaagttgctctttttatttgtcactttattgtaattgtcttaataattaaacattttcatggttcattataaatgtgcctggagcttctaagatgacccctaatgatctctatgtcctggaattcatacgtttgtataaatccctccccttgagtgtgagcttggctttagtgactcacttctagaaaacagaatgcagcagaggtgatggcatgttatttctctcttgagtgatctaagggaagccatctggcacgttgtgagctaccctgtggaaaggttcaagttgcaagaaaaacagtgggcttccatgaagtgaggaataagagcctcagtccagcaaccttcaagaaactgaatcctgtcaataatcatgtgaatgagcttggaaatgggtccatacccagttgaaccttcagatgagacagcagccctaacttgactgtagcttcctgagatgccttgagccacagacactgtattagttggttcttacactgctataaagaaatatctgagactgggtggtttataaagaaaagagacttaattggctcatggttctgtaggctgtacaggatcatggtgtcatcagctttagaggaggcctcagggaacttacaattatggcagaaagcaaagtgggaacaggcatcttacatggcaagagcaggaccaagaaagagataggggaagcactacacacttttaaataaccagatcctgtgagaactcactcacaagaacagtgcccaaggatggtgctaaaccattcacgagggacccacccccatgatgcaatcacctctctccaggccccacctccaacactggggaatacaattgaacatgagattttggtggggacacagatccaaaccattcaggcactcagtggggttatgcctggattactgacctgcagaaactgtgagattaaaaatgtttgttgtttgaagctgctaagttttggaataatttgttatgctgcaatagatgactaatacaaatgtcaagtatcatttatgcaagaggcactgttgaaggaccttaatgggatattctatctaccagtaattggttaggtaagtgggacagatgggacgacatggggtttgagctttgggataaactgcttaggtttagattctaattctaaacctaggcatttcattgctgggggatcctatacaaatttcccacattctttgtgccttaatttcctcatccacaaattaatagagatggtataagatctgccttagagggctgttgtaagaattaaagacctttccatgccccgggtgctgaactaaattttactctttattatcaggaggaattgttgcctaaggaagacaaagacctctgtatcaagatgcggaaagagtatacagataggacttgtccagacatcttagggctgagctcctaagccatgagtttggaaaaagatgctttctttttacagattcagggataggagagggaacatttgagtcttaattttgactaaaacttggctctaaggctgttgagcctagatagctgtagtggaagatggaaaacctatttttttttttccaaagggttgagtaatctttcaagaagtagctatttgaaaacactgttcctttgagtattctagaaaatattctttgttctgaggaaataaaataggccatttagttacacaaatagaacgcagagccgattggacagatgtttgcgatgccgttcaagagggaaacatgctttgctgagaatgtcaaaggttgtctatattgaaggcagttttgcatttaatttcctagggaaaaagatgtataactatttcagatggttgcttgttcctgcagtattttgtatgtttttgctcaggagttgctcacagaaaatgaaggagctatttttggtgattttccgggcacagagttaccttagggtaactgtgagaactaaggtccttcatctatctgataagtagactgaacacacattgtcccaccctgcatccaacctatttgtacgaagctacactgcctcatgtttcctatacagatgattgaagacatatcgtaaagagaagaactatagtatcttgcggatgctgctcatgaatagatggactaatcaaaacccaatgtcacctcagtagcaatgagcacacctagtagccacatgttggtttctaaataccattcactaaaaagaatcagagttccttggaaaaatggctgattgtaggggtggagcaaaatgattctggaacatcttgacatgccaaaaagtaacgaagtgctcagagaatgatgagaccaattctaaaggacgtaagagccagcttttagaagctcccactggccaaatttggggtaatatgaacatcaaaataatgataatacttaagaattataacctattgaataaagcaagaaggcatagcccatgctgttatttaataataaaggaaagctcatttttacagtagaatgacaacgaatacacgtagaaggcatgatgaaactggaataccagaatttagcaaccattataatatcaagacaaacaagaatcaaagaccactataatgagcaaacaatggagaagtaacaggatggtatttatataatctcaaaatacttctcagaaagatatttattaattaaaagagtaaaataataatttatagtagggagattgttccatcatttagaaaaagaatttgtgcatgtgtagagacagagtaaaatgttaattaaggaacccaggtgaagatatgtgggtattctttgtacaattcttgcactttgtctgaagttatgtcaaaataaaacaaaaaaagagacaaatgcaaactaaaaaaatcacaagtgtaaaattgtcccttcttccatttttccaaccaccatcacttcctttcttcctgaggcccagacactaagcaaggagggtgaggaatgcggcatttcaacggggccaaattgaggaggcttaatacgaaagcgccaaaagccaggcaagaaaatcacaggtctccccacacggtgggtgcctgggaaattctgaggtcaggatgccctgctccagcggccttcctatgttaaacccagctcttggctttttgaggtctgaaaagcacctagggtctgtaacaccctcatgctgactgaaaactttatcatctgaggtgacttcctatccatttatttgcttgattccttcaccagtccagtgacagggacttagcaggacttaacaactcccattttgcagatggagaaactgagtttctgtttattataacagtgtgggctatgccttcttgctttattcaatagggcatcctgcagtaagactaaaactcaggtcttggccgggcacggtggctcacgcctgtaatcccagcactttaggaggccgaggtgggtggatcacctgaggtcaggagttcgagaccagcctggacaatgtggtgaaaccccgtctctactaaaaatacaaaaattagctgggtgtggtggcgcccgcctgtaatcccagctactggggaggctgaggcaggagaaacctgggaggcggaggttgcagtgagccaagatcgcgccattgcactctagcctgggcgacagtgagacctcgtctcaaacacaaaacaaaacaaaacaaaacaaaacaaaccaaaacaaaacaaaacaaacacctcaggtctttagacccgggtttagtgactttttcatgataataaaatcacaggacgccagcggaaaacagttcagttatttctattccccaaaactaggctggacattctgtgtttttcacggtgtggtccgagaccaccagcagcagcagtagcagcagcatctgggaatttcttagaaatttaaaaaaccgggttcctctagacctactgaatcagaaactctgggaatggggcccagatacctgcgttttaatacgtgttcaggtgacggtgatgcacgttgaaatttaaataccgctctgggtaaatgtagcataactcttaatgcttcttatgacaatcatctcttttcacatatgactactagcctctctcgattaaaatataagtcatacagaatttggcacagaaacaaacgtaaggaattttcttaaaagcatcatcgttacctttcctggtaaatttctgtaacctcttcataaaccgagggttaatggttgattgggtttcctctagggtaggccaaagtatatgctgaagacaagagagtagaattcctcaagagtttgggaggagggactgatgacaatttttggtggttgactaagttttttaaaaagccacttctaagggtacattcattaaccagtcagcgaatccacttgttccagcgagaggtgggaggtgggggcaggggtggagcgtggggaggagcgacactcgccgctccggaatccgtgccttccaagtgtcgccgttgcgtcccccgcaacccccgctttctgatctccctcgaggcccaacacccaaaggctcacccctaggccatccgcgctccccgaccacctccctcataggactccttgggattcctcaggccgcgtccagccgagggggttcccgggcgcggtgcgcactgcccgccccctcactgcctcctcccgcgtctccgcccccgcggggccgctgggcgcccggggaggcgagggtgccgaggccggaaaatgagcgctgcccgaagggtggcccggagctgcaggtaacgcggtccagagctcaggccggagcgggccccgcacaccgtcccttccccgcagcgacccgcgggctgcgcccagggactgcgccgggcgcccgggctgcagggacgcgggcgcgggggaggcgcggccagccctgccctgggggacggtcgcgctccccgctggtcttgcagccacgtcccggcggctgttcctgggagcggcgggaggcggcctcggtgagccaggtcggcgcggcagatgcctgggaagatggagaagtttctgcagatcgcgcctcactccctggccatcgtcctgggcccggcagaggcgccggcgggggaaaggccaggggcagcccggcccgcgcccccggcccagccccgccagctcgcccggcaccacatcggctacgagatcttcgccgacttcaaagccgagaacatgcagcacttctggaacaagaaggtcacggccgcggtggccgagaccttcttcctgggctggatcgacgagcaggtcctgctgatccagggcaaggaggaacatctggaggcgctgcgcgaaggctggacgcgccgggccctgcggccgccctcgggcttccacatccgctgcctgggtgagtgcgaccgccgcgcgcccgtcccgtcccttcccaccggatcgcgtccgtgccgtgcggtcgcgggtgccccgccctgccccagcccgccgcgggcaccgccgaggctcccctgggtgcccgcgtccctgccgggggaggagccgggggccctctgcgagcgtgggattggggaacttcctggcaccgaaaggagggagccgtcccattcccggtgcgccgcccccgcctgcccgcgggagcctccccggtggcgggcggtgcctgaggccggccaggtgggcgccgcggctcggcgggcggctcggagggcgcggcgctcggggcgcgtgagtgtccccctcccggcactgctccgcggctggagtgcgcgggccgggcggaggtgggcggggaggattccggggctcgggtcgcgcggggctcccagctggagcggcggctcaggtgcgcccgggacgcccttccctgggcggcgactgcgggggacgcgccgggaagctagggttgaggctgagtgttgcgcgcacgcatttctcaacgaggcaaggctgcagagttcgtcttaaatgtctcacctgcagcacatctctcaagtcgttttgtgtgtctgagggaaggaagagacacaaagaggccggaggaaaaaaaatctgatcctcaacaaaagagagcaaaacgtaaagaggggcagagtcgcccagaggtgaaggtcgccgccgcgtttccagtgctgctttgacttgctggtttttattgcactacttcatttcccctccttaatccagtttgcatcgcctgtagaatatacttttgagttttgtactttgggttttatactttgagtttttgtactattacatagtaaatagtaaagctttaggaaacaatttcaaggaagaaagcattctttctagtcccgcggttcagaaattctttcttgacattttgggaggtcaaaagttcaaacgctaaaaaactgtaaagccgccttttctcgttacccgctgttgctatgccgccttcctctgaaggattagctgttacctgctgatgtgacgccatctatgcgtgtgacgaatttatagcatttttattttgttgtgttttgtctattttggcagagaagagatctttacaaagctttctttgacttgagtagacaaaaagctagtaaagcttgcatcttgtgtattttgtaacctgcgctgaatttcaaaaggtgccttgattttctcaattcttttgactttagcaagaacctcagtctctgaaattaagcggcctccgtaaagggccaaggtgaacgcctctgagacttaacttgcttttgccccgtaggactgtgacacattaggacgtaaggatatacgtagtcatttatatgcaccgtatagattgctctacaggcttttaataattttctttgaaattcgatttcacactttttaatgttttattttgcataatttcaaatatatacaaaagtagtataactcaaaaatattatattgaacccccaccgtgtactcaacgttccgctccaaaaagtatcaatggcatggccggtcttactgcatttatacccccatctaccccctacccgtacttttttgaaatctcagacattatatcaacttgatttcatttgtaaatatttcagtatgctcatgtattttttttatttcagcagaatttataagttcataggaattggtgatctgtcatattaaccaaagagaaatattttggcaatttttaaaggttccaaattgctctaattggttgactgttgccctgacctgggtaggtggcctggcctgagctgtctctgctgactggcaactgatggggcctgccagcctctgtagtactgagctcctcaccttacctctgcaccctcagaggaagcagagggactccctcttaaagcccaagcatcagataaaagagcaggggtgatacctgctgggatccaagtgctaactttcttttgaactgcctggggggtggggtgggttaaaaatctccactggaattccaattttgcttcagtaatgacggtaaaatgctgaattgtttgaaagatttttatctactataaaaattctcaatatctgctgcaggcttcctcatttttttttgttgccagatcttttattgggctttgcaattccagtctggaagctgatgaggattggctcacaaccttttattctgagtcacaatacacgtgatgacaagttcaaatgctggcggggggccggggcggtgatatgggggatcctggctgaaactctgctctgaaaagcgtgatgttataggaatagcctagaatcgatctactgctaaacgtacaaaaccagaaaccaaatgctatctttgatactttattattagtaatacatttcttgcagcatccctttcaattgacccccatctgtagtacatatatcgtcaggtccttttacattgttttgggattttagctcattatttcatgcatatgaaacggccatagagccagacacatagatgagctttacaggaggcgcattacattcccacttgttgaacttgaattaagctcatcagttaccaatagtcctctgaaataactggtagccaaaagtttgcttaagtcttatcattcttgtgggggatacagattatttataaaaattggttgtgtttcagatgatctcttagatcccaccatagagagtggtaataaaagtgtcccattagatcctgccagtgaagaaaggagaggaacggttttgccctgtctcttgacttgggttcgcctgggtgcatgatttcacacaacccagagcagagaggctcacaggcggggcgagacaggcaagccccggtgcttttgtctggctgtgctgtggtacagttgaggcaaacctacactttcacagcaggatttgccaggagttaatattttatgctgtaacttgaaacacctgtgttgaaatcataagcattttggtgcctgtaattccaaaagtatatggttctaaccaactgtaaaacttcaggtgagggttggacaacaaggagataattactggattcaacaagaagcagggtgttaagccactcaaaggaaaagtggttttgacttggcatcttccaattcactacttagaaataacctactagaatttgcaagtccattcttagaaataacctactgtgggcatatagaaaaaaagtttggacttttgattttcagaacccttcaaagggtatacaggatgctggtaatgttttaaaattgtgctatgtattttgagtaaatcacagtaaattaaagcccatacatgtttattgagtgctttctagcgccagcctctgtgtcactcctgcaaataggaagactgatgggacatgccatcttttggggtattctgacataagaaattgagagtgtgctaaatgctttgaggactctttgttttgagtgaacgagaagcagttacttctgtcttgtgagctggtaggggaggtttcccaggtatgaggcttgaacttgatcttgtgcagatggagatgggggtggggcgggagttcctgcagagcaggagaactttccctgctggggaaggaggtgcccggagcttgagtgaaggcttggggttggagagttcctgatgtgtttggaaactggctggggtgataagacaatggaaaggtgggagagggccagatgtgaagatctagaagccactggaggcttctaagcaagggtgggaatgaagtgatttgatctgtgttacaatgagaattccatgccagtgagggtgaagggtgggactgggaggggattagaaagaaataggagcactagctaggcctattgaaacagagggagaaatgccaagtgcttctttagagtgtttgctctccttcggtacacttgcacaggccacggttagtacccgaagaaagacaccattagtctggttgaggctggagggccttctagcctcggccacaagcccttagcctttgtgtggagccatgtgcgtgctccccctccagacctcagggagcacaggtgcatctctgtccccaaatgggaaagtggcactttacactttcccatttgatcctcacatgtttaaatagttcagaccaaatacacttttttagactttatatcagaacttgtattttgcattataaaattgtttagaacacatgggcatcaagattttattcttttccaaaatttttattggttttctcaaaaagagttgctttcttgaagtgatttccccaaatagtagatttttaagacagatttcttttttgtttttgagacaaggtttcattctgttgcccaggctggagtgcagtggcactatcatggctcactgcagcctccaactcctgagctcaagtggtcctcctgcctcagcctccctagtaggtgggctataggcacacaccactaagcctggctaatttttaactttttttttttgtagagacagggtctccctatgttgccaaggctggttgtattagtccatttttcttttttttttgaggcggagtctcgctctgtcgcccaggctggagtgcagtggtgcgatctcggctcattgcaagctccgcctcccgggttcacgccattctcctgcctcagcctcccgagtagctgggactacaagtagttgggactacaggcgcctgccaacacacctggctgattttttgtatttttagtagagacggggtctcaccgtattagccgtgatggtctcgatctcctgacctcttgatccgcctgccttggccttccaaagtgctggggttacaggcgtgagccaccgcacccggcccgtatcagtccatttttatgctgctgttaaagacacacctgagactgggcaatttacaaaggaaagaagtttaatggagaactcacagtttcacatggctggggaagcctcacaatcatggcagaaggcaaggaggagcaagtcacatcttacgtggatggcagcaggcaaagagagcttgtgcaagcaaactcccttttttaaaaccatcagatctcgtgaaacccattcactatcatgagaatagcacgggaaagatccgtccccataattcagtcatctcccacagggtccctcccataacatgtgggaattatgggagctataagacgagatttgggtggggacacagctccaaaccaaatcactggttttgaactcctggcctcaagcagtcctcctgtctcagcctcctaaagtgctgagattacagatgttagcacctaagcctggcctagaattattaaaaaaaaatgtacactccacagacatttgtatactcaaaagaagttacagttcaataacttacttaagtcaacttaaaattgaataatattcctagacgaatagcttgaattgcttaacaattgttttaaagccttttaaattgtagatattgattcattcagtgactagagcattcaccagttcctgggatgtgttctaggcactgaagtggagaacaagtcagatacagtccctgtacttttggaggctccattctagtggcacaacagacatttgaaaaattaaagaaatggtctgggcgtagtggctcacacctgtaatcccagcactttgggaggctgaggcaggtgggccacctgaggtcaggactttgagaccagcctggccaacatggtgaaaccctgtctctactaaaaacacaaaaattagccaggtgtggtggcagacacctgtaatcctaactacttgggaggctgaggcaggagaatcgcttgaacctgggaggcagaagttgtagtgagccgagctgagatcacgacactgcactccagcctgggtgacagtgagactctgtctcaaaaaaaagaaagaaaagaattaaagaaataaaaatttctaatatttttaaatgctgtaaaaattaagcacttgatagaatagagagcgctggggagaaatgacagaatagctaacatttacatttattgatcaccgactattttctaaatgctttatttttatgatctaatctaatctttaagacacctataccatttaggtatcattattttatccatatacaaataaggaccttaaggaacagaaagataaatgttctccagggatgcctacttaataagtgatagagccgggatgtgaacccaggccctgggatgctagaagcagtgttttggatgactactcgacagtacctcatttggggtgacacttgaccaatgaggcaggtatccaccaaccagcaatgacagaggagcaggtggaaatcagcttgctatgctggagaaacagagagggtggcccatggggctgggcttgttgagccaggaaaggagaagaaggtgtgactgcagctgaggtcagaagcaggcccaggccaggtcctgtggggccgtgtgggatggtattctgcagagagaaggcatgagtctccagaaatgtgcactgggttggggtcggcagaaaatttagagaagtttaagaagcgggcctggctcctaaagaagcttatctcttacattaaaatctcaggattaagtctaaacagtgaacaaggatgcatttaaaactttagtgacttctagctagtcataaaaaccatttttatgaattatctcactttggctcaaagatgttttcagcaaaggctgtcagtttcattgtaataaagcatttagaatgaacttctgagattccaggtcttgctgtgataaatctggctttgcaaagatttataaattttactgcttatagattaattatgatcttgagcacgtttgtttccttgtgggtttactttgaatttggaaaataaattgcatcaagaggtaaatttgctggttattgccaagttcttttaaaagggctcattaaactgaaacggtgtctgtgtcttgcgacgggttgaaagtatttagatgctttctgttcctgaggtcgatcatatattttgcggtaaaaacccgggaaagttcgttatatacaaactatttgctgcaaggaattttaaatgtcttcagtctgcctaaaatatcacacacagtgatgatctggtcaccttaaaaataaaattttcagtgtatgaggtgggctttaacattagttacttgaagtttggagattgtacttgtatccttctacttagtttatatatttgttaaataagttttaaacccttgttgcatagctgtagacatgatatgatttccaacatttcttaatttgggggaaactaacgatatggtctatagtttatctcaatgaggaataaatagatgtattgccaaagtacaagctttggatctaattttttaatttatagtatactataataatagctagatctggatttttaagaaggccttctgtcaagagcttttaatccacttgaatcacagtaggccaagcatggtggctcacgcctataatcccagcactttgggatgcctaagtgaggggatcactggagcccaggagttctggaccagcctggggcaagatggcaagatcccatttctacaaaaaagttttaaaaaaattagctgagcatggtgctgtgtgactgtggtcccagctacttgagaggctgaggtgggaggatcgtttgagcctgggagatggaagctacagtgagccaagattgtgccactgcagtctagcgtgggtgacagagtgagaccctatctaaataaatacaaaaagtaaaaataaaaatcacactggcgtgggatgagctggcttaaacagctcttgatagcttggcatcagtctctcttgatgcggaccagtcaggctggacactaccaagggccagagctggcggtgtgtctttgagaatttgataaatggataaatgacttagataaagaggtagaaaggattcatccaagtctttggggcctgaattaagtgggtaagttgagaaagtgcatgggacagtgggagaccccatgctgagcagatccaggtctgaatttgtccttatgacattaacactttggaagcatacctctgtgctgtagatttcactctgaagatgaaaataaacacgattaaagactccattttcccaatttattgtgaaggccctgtaataattttctaaagtgacagcccatctgtcagtgtaaaatgacttgcttctgtaagcaggatgtcacctccccactccccaataacgtacgtttgggaagcacatgatgtcccttagtctagctctctggcatggaagctggggatgcatagtgagtccaaaatcacctccttctcatgaatccgggagtccctggagctcacggagggcttcctggtgtcttgaaggggtggaatccagtctggggcgccccatcttcctgccgcctgaggttgctgcagccttctgtcttcactgtgaaccccgggatactgcggcggtgctggctggaaggctggcttcccagagcagtgacccgctgtggcctgcttcctgagagctctgcgtgtgacagcatttccttctgtctcagcctctgccagcgctgtgtcaggtgcctcccttcttcccccgacccccactttccctccaggatttggactattttttcttttcaaaccattgcaacaaaaggttatgatgacacctctgcctttctacttctaaataaggtccgccgccgtccaaattttgaggaaacaaacatttatgtgttcgtgttcaggacggtagggcccaggacatgcccttgtaaggcaagtggtcttcagagattccagactcccccgcatgcactgcccccacggccccacagctcgaagcccccatgcctggagggggcctttgtgagtcccagatgctttctgacactttctttttttcttttttttttgagacggagtcttgctctgtcgcccaggctggagtgcagtggcgcgatctcggctcactgcaagctccgtctcccgggttcacgccattctcctgcttcagcctcccgagtagctgggactgcaggcgaccaccaccacgcccagctaatttttagtatttttagtagagacggggtttcaccgcgttagccatgatggtctcgatctcctgacctcgtgatctgcccgtcttggcctcccaaagtgctgggattacaggcctgaaccaccgcgcccggcctctgacactttcatgctgaaaaagggaggagaacttctccatatttagaggggcaccacggtggatatgatttccaaaacaaattttattatggacagcagtccccaggcccttctggtgtgacccctttgggatgctttccactcttgggacagtcctgcagtccttgcaaaccacctgtcagcctaaggcgccagtgagcctgcccgagccgccagggtttgcagcctctctggccaccgtgtctcatcgccttccctctttgtcatttggctttgggtgacaccttctctagggaacacttgcgctttatctctgcggccttcacagccccacaccccacacccaccccactcccagctcagcttcttaatcctgcctgcttgtttggcagccctggtgggtggatggagctggaagaggctgagctgggggaggtggggtaggcaggtgagggcccagggtgctcttgaagcagtgggctgtcagcagggagatgggagcatgggagacggcccagatgcatgactgggagctgaaaaaaggcgagggagaagatagaggaagaggaggtgtgaggggagcagctgcctgctgtccgtgaggctgcagcggaaggctcttgctgggaatcaggccgctttctttgtggatttatctacccaacaggcctgcggggcgggctgagctctcccagccaatttcgccaaggccaggaggaggactaagggatcagcgcgggttcccgtagcagatggaccccacattacacctgctgggtgaaaagaactgtccagtctggacgaatcactttggtttttcctttttaaatctctgttctctggtcaataaaccagactctcctggactcttcctgaggaagtgaaaggaggatacagctcagtgaactctgcggcgcttctggaaagaaatccagttctctatctcatcggttagggttacatctctcctgtagtcttgttacagcgccaccattcattccaatcctcgcctgactccctccagcagtgcctctgggctccaggttctcctgaccggtcacttcccctctgtcctgggttggtcgtgataggctgggaaagccttggaaggcctgctcactttggagttaatatagaaccgcagagacgggaagcatcctttgttttttgttttgggggactttgtgactagcataatttgtctaggttgatcactttcctttcatcagagcctggttattaatttgtaacaaaaagtttgtccaaggaaagtctttaatcgttagtagactgtgaggtaatgtagaaaatgcagaaagcagtacgttttaaatataggaaatgcagtaatgtagaaaaacaaaagcagtactttagacactgtctgttcccagataataatggttactctagcatctttgtttcatttttacctgtatctttagcatttcctcttatattgaaaaaggaacattctagaagacagtctttatgctatatacttcttcattctgttagatcaggggtgtccaatcttttggcttccctgggccacataggaagaagaattgtcttgggctacacataaaatacactgacactaatggtagctgatgagctaaaaaaaatggcaaaaaaaatctcatactgttttaagaaactttaagacactgggggtcttgattgctttgaattgtttttctaggggtagtgatgaatttgtactaaagttttcatctgtacgcattgtaaacaataggacatgcttgaattttgtggaatttggatacgaattagagctgttatttatttatttatttttgagacagagggagtcttgctctgtctcccaggctggagtacagtggtgtgatcacggctcactgcaaccttgagctctcagactcaagagatccttccgcttcagcctcccaagtaactggggctacaggcatgagccaccacacccagctaactttaaaataaagttttttttagtggagatgacatgtcactatgttgcccaggctggtctcgaactcttcctcaagtgatcctctcgccttggcctcccaaagtgctgggattacaggcgtgagccactgtgcctggcctgatctgatttttatttttatttatttattgagacggagtcttgctctgtcaccaggctggagtgcagtggctcgatctcggctaactgcaacctctgcctcccttgttcaagtgattcttctgcctcagcctcctgagtagctgggattccaggcacgtgccatcacacccagctaatttttctacttttagtagagacggagtttcaccatgttggccaggatggtctcgatttcctgacctcgtgatctgcccacctcagcctcccaaagtgctgaaattacaggtgtgagctaccattcccggccctgacttttattttttaagtcaactctccacttttggagaaatacagagatttgtgttttgattatgtacttgactttctagaagccaaaacagaaaaacatacagactttcaacattaccgttgtatcttttcctttagtacacttattttgcatttgctatttttgataaaatgttttaagtgctgtttccctctgaaatactttttaaaagttgaattatgagcatcttttattctccaaaaaattatagataggtttttctatggaagactgtgaaatgtcagctttttgtaaatcactaacagtaaactgaattcatagagcataactctcgaatgttcactgccatttttacctatgaagaattaacttgtttggtggtttccttttgaccttgtaactacagtactgctctgcatggataaataaacccggattctctacccttgaccctaaggaggagtagtggggacagaggtaagtgtagctgccaccttgcagttgcagggagggactggtgtaggaatgagttggtaaaatgctcactttctggcccagaaacctccttcattgtgtatctggaccagggactgttgaggatgcttctgccctaggttaaagaaaaaattatttaatgttacttttaaagtactgtgaggaaggctttatcaggaccaccatggtaggtacaggaagcagtgcaacaaggttttgcagtaggggagagaaattaggctcaactccaaacacagcatgggcaagtggcaattcattgccaaagaaagagctgggtggaagtcagtggctggaaaattactaccaagaaacatcaggggtgctgtggtttaaatgtgttccccaaagttcgtatcttggaatctaatccccagtgcaacagcgttgacaggtgggaactgtaagaggtgattaggcaatgagtcctttgccctcatcaatggattaatgctgttatcttgggagtgggttctggataaatggatgaattgcctgcaccctcacccccacccccaccccatgcaatggcttctcccatgttgtggcacagcagggggccctcacaaaattcagccccttgattttggacttcccagcctccagaaccataagccagatatacttctgttgttcataaattaaccaatctgtggtattctgttatagcagcacaacatggactaagacaaggcacgaggggatttctggctaaacctacctaatagaattcttgctgaagacaggccagggtgatcagacagcacgtcgggggtggtgggggatgagaaacctgatcagatatcaaggattggggttcttgtcaaaccgatttagtgcagggttcttttgctaaagtgattttacaaggaagtgtacagatgggcctacgagaaggttcaagagactgactacagtttggccaagcagagaatctttgtcactgaccaagtttcaaaggacggggaggggtgatagatggtacatggggactgacacccgtttattcttaggagactacatcagttggtttggaaattggaattgtttttgtttgtttccagtttatattgtgttaagtctatgttagatccagaattcaaaagcagaaaggtgagaaatgtgggcattgctatggagttaaactggctcacagaacaagcggctccctcaggcaatcctaggaacagattttcagacgttacaagcaccaggtatttgatccaggcctaaagtatgaagcgccatgctgttcctttgggtgacaagttttggtttttgtcacatgcttctcctgttttaaatcttccatctccttcatgtggaagagattgtttatgtttaaaactgcttatgccaaatcaagaagtaaataaaagcaggaaggggaatagaagctgcttatagcagcaaatctttagtttgaagaagtccatgaagacagattcacatggaaattgttgatggtgttaattcagtgatatgtgactaattagaaaatgtttcctgtgaaaaaagtttaattcatgaatagttttttcctctcctctctttcttcttttaaaaatgaatactttagatatgtctttgacactatggaagagataaggttcagaaagctccaaaatttctttgttttcttaaaataatatcagtttcttttattcttaagtgtgagcccatttcttataaaatgacctagtgagaaagcctggatttttttttttttttttttttttgagacagggtctcactctcacccaggctagggtgcagtggtgtgattatggctcactgcagcctctaccttctggaatcaagtgatcctcccacctcagcctcctcagtagttggaactacaggcatatgccgccacacccaactaacttatttttatttttgtagagatgggtctcactatgttgcccaggcaggtctcaaactcctgagctcaagcaacccttttgccttggcctcccaaagcattgggattacaggggtgagccaccatgcccagccgtctgtgattttcttaaagtccagcagtttgtagctatatttgcagttaaaatgtgaaatcatatttagccagcaaatttgcatgtaatttgaataaactataactttaaatttactttaaatgtactcaaactgatgattaattgataaagttgcattgtgcttaatacctttaaaaatgtctatgcaatttaagggtttttagatttgtttaaaaaagtgctaaaatcagtattaaatttttaaatgattttttcttccctcattaaaatttctggaagtttattagtagaaactcagttacgtgctgatagaatatgcattacagttgtttctaaagagcagctcaacatgaattggtgagttcacatcatttctgtgactacttgtgaggactgacttttcagaatataaatctgtactgcccagtctaaggatcgagagtgtgatctaataaaaaaaatgcttttactttcaaggagggatttagagtgtgtgcagttgtgtagagagaatgtgaatgattttctctaagccctgaccccatgtactcaaaagttctgaactctaatgaatgaatgcagccctttgtaacactgctaacatatttaattttccaagtatgtaggtcattgtgctgattttgttctcataccaaaaagattgtccaagcatttcaatgaagatatttcacacactgccttctcaagtcataaaagttgaaaatgattaccatttatgtgatcaattatttaaaaaaataatttgcatttaaagtcagccctccgtgtctgtgggttctggggccacagattcagccaatggcagatggaaaatattcagaaaaaatacaaataaaaaaccaatacaggcagggcatggtggctcatgcctgtaatcccagcactttgggaagccgaggggggcagatcacttgaggtcaggagttggagaccagtgtgtccacatggtgaaaacccgtctctactaaaaatacaaaaattagccgggcaaggtggcgggcacctgtaattccagctacttgggaggctgaggcaggagaattgcttgaacccgggaagtggaggttgcagtgagctgagatcatgccattgccctccagcttgggtgacagagtgagaccctgtctcaaaaagaaaaaagaaaaaacagccaatgtagtctaacaactatttacattgctttaggtattatgggtaagctagagatgatttaaagaatctggaaggatgtgagtaggttatctgtgaatactctgccatttgatgtcagggacttgagcatccgtggattttcgtattcttggtatctgatcctctgtaccgagggaggcctgtgtgttctacttgcttatgttagcaggacactttgaatgtgtctttcccattagattgtaattcctttgagggtggagactataaacttcagtttatattttcgagctcagttttctatgtaatgtggatctataagtattacataaatatcctcacaggtagagtcaatgctaattggcggctggtagtaatttctaaactaccattttaacactgggggaaaaacactcagtactgacaagggtaaaataaatctgataccttaatgtgctgccagtgaaattataagttgaaaaaactcttctttggaaagtatcttggcagtctgtatgagaaagccatctaaatgttcatatagtttgatgtagtaattttatttctggggctatctctaagataatattgcaaaattttggaatatttgtaatattgtcttagagatagtcctagaaatagagttactgcatcttacattttgtagagagctatatgtaggaagctattcattacacaatttttaaggaagaaaaattgcatataatctaaatgccacgaatggaaaatattaggtaaattatggttctttatattggatggaatagtatatagccgttaaaatatctatgaaggttatgaagcaacatagaaaagtgcttatgatatataatgtcacttagaaacacatggaatatttcacaacaatacaaattagaacagaatcttaaaccagatgcttagggaagatgggaaagaataacaataattactgtatattgagtaattattatgttttagggactttgccgagtaattttctcacttaatttttataaatggctcttggtttgttcattttgcggacaaagacactgagcttagagaggttgtgtaatcttgctcagccatgttgagtgatgggactgcatcgggaccaggtctgcctgtgggatccagggtccgtgcttgaaactggtaatttgcaaatttttctgtgtgtcagaatcatctgagaactttaaatagataaatgagtgagcaaacaaatacatgccccgtggcccacctcctgaattagtcacctggcagacaaccagagcctggcacggtttacaccaagccagggtctagtgccagcctgtggccagcatttaggaccctctgcacattccgtttgttgggtacaacacaaatattaaaatacatacaaaaatacacaaatattaatactgtgaatattaatagtggttggatttgggttagagaactaagtgattttagtcttttttcttcattttcagattttctttagcgataaatgatgttactttgagtataaagatttagtaaaaagaaaattgaataaaagatttgatttagagtccttcttttggggggaatattttattttattttattttattttttttcaagacaaggtttcgctctgttgcccacgctggagtgcagcagtgtgatcatagcttgctgtggctgcctggctcaggtgatcctctgacctcagcctcccgagtggctgggactgtaggtgtccaccaccatgcccagctaattttttttttttattttaatagagaaggagtcttgctatattgccaggctggtctccaactcaagcgatcctcccgtctcagcctcccaatgtgctgggattataggtgtggaccactgtgggcctgtgttgttgctttaaaaaacccactgtgaagatgcataagtggggaaatggaattgtagtcaaaagaggcttaatcttagcaaaatactataaaatgtatcagtctaatgatgatgacacttaatagcatatattaaatttatttcagttacaacattgctttagaaattaaaatgaactatagatttttaataaatgatatattaattatatctcaatttaaaaataaaataaaataaattggacaattacaaaaagccagtgagattggcctgtttagctctttgacaagcaagagagaaaactataattgcagaacatttttgttgtgaaggaaggggaataaaattcttttactcatagttgagaagaaacagagtgaagtgagatattaattacaggacacagtggactttattgttactgttcaaccttgtggtcctcagcatgggtaggtaaacacgagatcttttgaatgaggtctctcgaacactgcatgggcaacaaatgcgataccttaaataaggtataaatgatgttgaaaagtgtctattttcaggaaggcagaggaaaatgtcaaactttagacaacttgtgtgtgtatttttttaaaatcaaccacttatttttatattattgatactattgacatgaaatgataaaaaatcttgcatacgtggttggacacctggagtaaccttagcatccagtgtccaacagtacattattgtaacatcttcctcactttgcaggcctgccaaatttcagaattcctgggtcaatttggaagaaaaccaaatcgattcgtaaggaataaccagcgatttcatgagtgattcatgtggacatgaatgtatattgtgaagagtaagaggaatattggatatatttttaaaagctgagcagtggtgccagttagccttagtcataaaagtcttattttaaaaatggtgacgtcaatagcaaggtcatggaatcaacacaagtgcccatcaacagtggattagataaagcatggaatactatgcagccataaacaagaatgaaatcatgtcctttgcagcaacttggatgcagctggaggccattatcctaagtaaattaatgcagaaacagaaagttaatatcatatgttctcacttataagcgggagcaaaacaatgggtacacatgcacataaaaatcggaacagtagacatcagataccctaaaaggagggaggaggagggggaagggtggaaacaccacctattgagtactgtattcactatttgggtgatgggttcaccagaagctcaaacttcagcattacatgatatatctgtgtaacaaatctgcacatgcatcccctgaatataaaatttaaaaaaaaaattcaaaaaaatttaaatggtgaagtgtattcatttattttggaaacatcacttttcttccacacatgagatggaatggaactggaacacattatcgaaatccacaaaagctgtgaaaattttatattaaataatcctgtaacttgaaaagattttaaaaagtcctcattaaagataggctcatgaaaattagcgtatttttgtgtctgccaaaacttctttgcagaggaaatggggatgaaattccagatgatgtctttgtctaactgtacgggcaagggctgcattggctgaattgatgacttcgctgaagctattgaatttctagtgttgcctcagatcacgtcatcatttttgctgtgagctctgatagttgcaattgtgttcaactcctggtgagtgcagcacatgcctcaagtcatgagagatggaaaaggactactgttttctgcaggtaggtggccaccactaaagctttgaaatggtgtccacattcttggaagctagtgaactgaagcaaagaggaaaagaaccctccaactattttgggggctgatctgtgtcattcataaaagaatggctttcaaaactgcttagtaatctaggggaaaacctcagtccttaccaacaagatggttcactgggttcaaaagaacgtgccacacacccggaggcgtgccttgctttgcaaccctttgcatgctggctgcagggtccgtcctttgctggcgatcagtgggaagtatggttgccagactatgagctgaaagacatagtagccctatttttggatcgccagggaaaaaatcaaattgtttgtacttaagaaaagtcctcaggtggagcattgtgtatttggtagaaagactggaaactccaaatacacagaaatagaaatttcaagggataaaaacaaacattatagttcatgcatttataaacaggttttaaaataattataagccaccaatttgatgacactctcaagacttcgtgagagtgacttttgagaagttacatctcatccagtttaggtgaattcaggtcacctactcttgacatgagtagagatttgcctttgtgacttgtgaggagagaccttttctcaccgatggtattgaaaagagaactccaagcgaggtttgggaagaggaatttgattcaggtgccagatatactttacagatcactgtggttatcttacattaaaacaagcaaatgtgcatcttcaggtattatcttatttctttcactcacagacatttgctgcactgttctccccacctcacgcagcagaacacttgggtatgaagtaactatcactgtactttcggtgagcaagcaccctcagcattaaaaaaaattacatgacaagaaaaaatatgtatgtttcaaggcgactataaatatttttctttttttcttttcttttttttttagtataatttttttttttaattgatcattcttgggtgtttctcgcagagggggacttggcagggtcataggacaacagtggagggaaggtcagcagataaacaagtgaacaaaggtctctggttttcctaggcagaggaccctgcggccttcctcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacaggtgttggaggtaaggtcacagatcaacaggatcccaaggcagaagaatttttcttagtacacaacaaaatggagtctcctatgtctacttccttctacacagacacagcaacaatctgatttctctatcttttccccacatttcccccttttctattcgacaaaaccgccatcgtcatcatggcccgttctcaatgagctgttgagtacacctcccagacggggtggcggccgggcagaggggcccctcacttcccagaaggggcggccgggcagaggcgccccccacctcccggacggggtagccggctgggcgggggctgactccccacctccctcctggacagggcggctgctgggcggagacgctccccacctcccagacggggtggctgccgggcggaggggctcctcacctcccagacggggtcgcgaccgggcagaggcgctcctcacatcccagacggggtggtggggcagaggcgcgcgtcacttcctagatgggatggcggccgggaagaggcggtcctcacttcccagactgggcagcggggcagaggggctcctcacatctcagacgatgggtggccgggcagagaccctcctcacttcctagatgggatggcggctgggcagagacgctcctcactttccagactgggcagccaggcagaggggctcctcacatcccagacgatgggcggccaggcagagacgctcctcacttcccagagggggtggcagccaggcagaggctgcaatcttggcactttgggaggccaaggcagggggctgggaggtggaggttgtagagagccgagatcacgccgctgcactccagcctgggcaacattgagcactgagtgaacgagactccatctgcaatcccggcacctcgggaggccgaggctagcagatcactcccggttaggagctggagaccagcccggccaacacagcgaaaccccgtctccaccaaaaaaatacgaaaaccagtcaggcatggcggcgcgcgcccacaatcgcaggcactgggcaggttgaggcaggagaatcaggcagggaggttgcagtgagcagagatggtggcagtacagtcctgcttcggctgggcatcagagggagaccgtggaaagagagggagagggagactgtggggagagggagagggggagggggagggagagggagagtgggagggggagggggaggagggagaggcgaaatatttttcttttaaaatatcattgctttgatgtttttcattgatgcacttaattttacttcaggtgaaatgaaaggagggcgtgagatattttatgttcgtcaaaaggaagcatgggtgaaaaaggcttgaacggcatcgccccactaaatcacaaggaggagaataaggttctttctccctttgctttgctggcttttgggccatgctctttttccatgcaaactgccgttgcctttggaggagaaggtggtgaggttatgctcttaaatagggtaagcaatgttctggaaaatagttttacagtacagttgagatttggagtgcttagagaatgtgcattatggtataagtatcagagttaaactaaaatcccaatgaatattagttcatagttcttcttttactctctttttgaagtatgcgctagtcacaccattaaaatgatctgaaaaaatcctgactttttcttttttttaagagatggggtttcaccatgttggccgggctggtctcgaactcctgacctcaagtgatcctcccgcctcggcctcccaaagtgctgggattgtaagcgtgagccaccatgcccagctagactatttttattttattaccagatgatgttctgtgttcatgaggctcataacctgtttgtgcatgtgtgtctctggttttcacatcttgcccctactattagggtcttatcttgtgaggaggtgggccactccatgtccctttcctctcctattgccgcttctctcattgatgtcattgtcaggtgacaaacctgggtgccctgccaggagctctggatttgaatgtgggccctcatccctgctctactctttaaaagctgcagggtctcagacaagtggctctcctattggaggattcaatgagattaaaaccataaatgtatcaatttattctttactgttttaaaactttgagttttgagtaaatttcttttgatctgtctgcttatttagacataacagtatatggttattagaattattaggctatgtatcttgcaaaggactgaaattgtcatacttagtttcaaagtatgcagattgaataacagaagctgtctgtgcagtcaaatctggctgatccccattatggtttttgagacattcaaggtaactcagaaaccaggagattaaaaaaagaatgaagctaaggagtgttttggcagagcacggtggttaactcctatagtcccagcactgtggtaggccgaggtagaaggatcgcttgagctcaggagttcaaacacaacatagtgagaccccgtctctacaaaaaaaaaaacaccaaaaattagcctagtgtggtggtgaacacctgtagtcccagctactcaggaggctgaggtggcagggttgcttgagtccgggaggtcatggttacagtgagctgtgattgtgccactgtactccagcctctggcaacagagtgagaccctgtctcaaagaaaaagaaaaaagaaaaagaaaaaagagatttttctcttcacggttctgttgagttcctggccctcctttcctgatgccaatctaatatagcataacgacttaattttgctcttgaattgtacacagaggcttggtgagaaccctcccttggctggaggcccgtgtgtaaccatatggtgcttcacggaatgcagataatggctttattttcctccctgtcttaataggtggaagcctgtgctagcaggtagaggatcttttataaagaacaaacgaaagcattacactgatattattcatgccagagcacagcaactgttagctgctctgaaaattgtaattccttttcttctacctgctggatattttcacccatgacccttaagagaatgcgggtgatcccaacccttgctgcgaaggtcattgctcacagctccccatcttgctgtgtcctttgttctgatgtcactggggttgggcctgaggcctctttgggaggctggcaggcaggtaggctgggaaggtgagggttggcagtgtgtcctcttccggaactgcagggtgctgtccccactgtcacaccccaccacctcccttttgagccctgcctagaggggaggggaggggtccctgctgctccagcagcctccccctccacatccctgcggagcacccatccctgtccctgttcctgccgggctgcattctgacccctgccccaggtttgtgagtctgtagggtggggttctagtcacagagttggagcttaggatctaacagaaatggatggggctttagaagtctatgtcccccaccctgcccttccctaaaaaggacgcttgtgtgtggaaaaggtgatacagtttgtgtcgggtcttgcagccaggctggctgggggtgcctaggtctctgggatttgccctcctgggcagggtgctctgcaaacttcccgtcctgatcagcctttcaggccccggattatggagtctctgccacccacgtgctagggagcatcaaacccccataagccacaagcctagatgggattcctgtgccctccagagaggacagatcccatccatgctggagagtgagcttttaaaaagctactgctaatggaacgctggctgtagcttagattgagaagtaacccatttatgtatatcatggtctccaacctttttggcaccagggactggttttgtaaaggacagtttttccacagactggcatgggggatggttttgggatgactcaagcgcatgacctttattgtgcactttatttctgttgtgattacattgttatatataatgaaataattatacactcaccatcatgtagaatcagtgggagccctgagcttgttctcctgcaactagacggtcccatctgggagacagtgacagatcatcaggcattagattctcataaggagcacacaccccagatccctcacatgcgcagttcacaaaagggttcacgctcccatgaccatctaacgctgccgcggatctgacaggaggcgcagctcaggtggccatctgagcgatggggagcagctgcaaatgcagatgaagcttccctggctcgcctgccactctcctccttctgtgcagcccagttcctaataggccacagtaccggtctgtggcccaggggttggggacccctgtgatatacatgattgtatttaatcttcatggaaactcagtgaggctcttcttatctctattgtctaagaggctgaaattcagagaggttaagtatcttgctggaggtccagctgtgcagtgctgagacctcagcccaggtctgcctgactccacggctgagcctgcacatggctctcctagccttcctgtgtccgacccatctgctgtgcacctcctgagaaccttcgggtgctcttgaaagcttgtatgatctacgtttttctttcaatataaatgtaaccgcaatgatctagcgatgattctctctttttaaaactatcacttgggctgagcgtggtggctcacacctgtaatcccagcactttgggaggccaaggtgggtggatcacctgaggtctggagttcaagaccagcctggccaacatggtgaaaccccatctctcctaaaaatacaaaaatcagctgggtgtggtggtggatgcctgtagtcccagctactcgggaggctgaggcaggggaatcacttgaacccgggaggcagaggttgcagtgagctgagaatgtgccactgcactccagcctgggcaaaaagagcaaaactccgtctaaaaacaaaacaaaaaacaaacaaaccaaaaaacccccaactatcatctggaggcaacagctggctgtccagaagtagactgttgaaaggcaaactgttacacaataaaagactttccttcccactagcccatcacattccttaggctcatagacctggaagatgagggaatgtggagctgtgctctctgccctaatcgtagtagctctggtgagtcaccagatgtctggcccacaagaagttccagcaaagcacgtcctcatagctctgggcccgagagacaccagtgcctaaagggctgtcacacttcccagcccatctggcggaggctgccgcgggtttgaaaacttacctgatgagcagaggcctttcaattccaaagactttcacaactttcctggcgttttccttggctcttaacatctgtgcctctagactgtaaatcctctagggcggggattttgttctttggcacattttagctattgtaaagcataatgtacagcatacgttaaaaacagtataacagcaaggcaattttgtccttcaaatgcggcttcaggtcttgatctttttcccagatacgcagacatgtgtagccatgtatcgtaaaatcggctactgaactttctgtgagaagtggtttccatgagatccatttgtggtgttattgcaaacttgggaaggcatcagatgttagaacaattcagcagttgtatacatacaatggtttttttgagctttagctcataaaccgtcacctactttaaaataattttgggattaaaacaatgtaataataaattcatactggccagaataggataatttaagcagggataccctcatagcaatttttttttctgggtcataaagctaatacaatattctcaccacctgctaatgttcctcatattttattataaattatttctcaccgacattctactttcatttaaggctattttactttcctaggccttgggccttgggtaatttcgttaggtaaatttctgttacatctgatttgaaaaggcacgctggagagagggaaatggaacggccagccatctggatgaactctgagagcttctcaaataaacagccacaaagatattattgtgtgattcgtgtgccctaaaacttaaagtataataataataaaattaaaaaaagatattattgtgtgattatagaaaagtttcttaatttgctgtaaactggtaaacagaaattatatttatttgacatgggataaagttttgagggaagcacagagtaaaatgtgcattttgtaaaaataacagaatctgaaccaatagaagatttatttagtatgtattatgtgatgcaccaatactaggcgccatgggagaggcaggagacatcatgcatttagttccagctgctcaggactcagggcttccccagacacgcagggcagcagactgtggcgggtggttaagtgcccagatgggggcttccaggcaagtgctgtgagctcgtgaagagaggggaccgatagagttcaattgtgacccttgccctggactactaagtgtgcaatcacaagtgggttctcttcttggcctgcacaattggaatgtccccatgtcccctatctcctcacacaatcttgggcttggggatcggggaggaacatggtggataatccctggctcttaaggaccaaggaggctgctcatcaaagacacttgctgaaaagaggcagagctaggactgagcatccaaggtcaccccatggtgtcaggaggtcgtggtggatggtctcaggtccaccatgaggacggctgggacattcttccagcttattttgctttgaggatcttgagctaattatgcatgaggaggagaggctgtgggcgaggaaggaaggacgtgttcttaggagggagatgcagctgatgaggcttcccaagcagtaggttgggaggaaggtgggccgggagcggtcagccttcacacagctgggccatccctcgtgtggcgcgtgctgcagatggcagcggtcagctcgtgtcatctcctagcatccctggaccgcaaaacaggcttgcactgggtggcaggcaaccttcaatgggtgaatagacgttccttcaggcccaagtgcaggcagccaccctcgctgtaggtgtgtgtgtccgtgcctctgtcctgccaacgtgggtgcagcgcccgacccctccctgcccgtcctctgtgtcccaggactcgcggtgaagccctgagcatgggcttccattgttattttctgaggatagcttgacaggacaggggcaacctagacctagtggagcaggagtcagggtcagcgaggtggctggggctggactttgccggggaggggttcagatttaatgcttcgagcagtggaaagctgctctgggctcctgagcacaggcagggtgtgatcaaatcagtgtttggggaagtttagtctgggaacgagtatggcagtcagtttggcaaatgatggggagaaggcgcgagaagggtcgttggctgtgagctgaaaatcgacaccatttgcagtcgctgaaacctttgggtaatctatcacctcttcttctgctctttcctgtttgtctaatctagaagttctcagtttttagtgcacaacagactcatcgggaaacaggttaaaacacagactcctgggccccactcccagggactctagctcagcagaccaggagtggggctggggacctgcatttcgttttcatttcgctcctcagatgattccagtgcagttgattcgaggaccaagtttgagaaaacaaactcagctgccaggttccatctggttttggtcttttttccctttctgttggggcacttctttctgttctcatcaccactgctagtcctgacccctccatggtttccctgagccttgcccctcaccgtcctcatcagcgaacctgttcccctgagaatggcttgctcatctatctcaggggatacccaggcagcctctggctccagcgactccctgtccccgtcactggccttcgaggcacagttcgtcttccctgtgaaagctgccactctgacctccctgctgagtaagtgtaacctctctgctttccatttccatggcttgtattctctacaccacttcactcctttcaaatacgagccattagcttgtcgaaagagcaagaacttggtatcacacagtcctgggacggctgcctgctagcaatgtggccctggcaggtcacaccatcgccctcaacttcagttttcccgaccgtggaatctgccccgcagggtttgcggaggcttaagtgggagaatacacagtgtccactacatagaatgtgtttggacaaatgctatttctctttcttttctctgcgtctggaatcgccagctggaccaaagaccctcagaagagaaaggctgtgttttatgttcctctctgatctcagcattgagcttgctgctcaacaggcaatcataatgcaaaaggcagtgatagtagtagcggtaatggtaataatagtaatagcaaatttataagtatttatgatatgccaggcattacatataacatgacctatttaatcttctcaacagagctttgaggtattggctgtcattaacaccatctgaggaaactgaggcacagagtggttaggtgcccagggtcacctagctgctatgtagtatagtcagtatttgaactcagaaagtctggctgcaaccaccgtatttttatagcactgaaataaaaataacccctattttattgttatgaaaaatgtcagtcatttatagaaatggaatagcatgggtgcggtggctcacatctgtaatcctagcactttgggaggccaaggagggagcatcgcttgaggccaggagttcaacactagcctgggcaacacagcaagaccccagtctacaaaaaatgaggaaattagctacgtgtggtgacacgcacctgtagtctactagggaggttgaggcgtgaggattgcttgaacccaggagtttgaagctgcagtgagctgggatcataccactgcactccaggctgggtgacaatgagaccctgtctctaaaaaaagaaaataaaaataaaaaaacaaagaattggagggaatgagagaatgagttcctctttactcagctttaatgtaatcaacacatggcccatgttgtttcattggtgctgtcacctctatcttcactttgggttattttgaaacaaatctcagacatcatactattgtaaatacaacacattagcaattgtatttacaatgaacttgtacatattttataaataaatttcaaaaagatgggccaggagtggtgtcacgtgtctgtagtcccagctgctcgagaggctgaggcaggaggattgcttgaacccagttcaaagctgcagtgagctatgcacaccactgcattccagcctgggtgacagaatgaaatcctgcctcaaaaaaaaaaaaaaaaagaaagaaaaaaagacggcctttattgccccagtataacctcaatgccattatcagacttaaaaatatcatattattggtaattccttaataccagctatcctgtttgtgtttaaatttctctgatgtttgcataaacatttttttacagttcatttgttcaaatcaggatcccaacaaaagacagtctatttttgagaatgaatttttaaagcaaagtacctgaaaatgttgtgtacttgttgcactttattcagcaaatgtttattgtgcccatgtttgcaaggcacggtttgaggctggagaaagagacttccaaggagctgccagctggctgtgatgacagggtggactcggaaactggcagagggtgttggcgcattttgcctctgaagtcataagtttgggtgagtgacacagcggtagagtcttgacagggctggggaaggtgggaggaagaaacagccccaggaaaagaggatgggtgtggctcgggggatgtgtttagattcttcagtcatattcagtctaacatgtctatttcctgtatttcattcttcgtctctacccttccacttgatttttcttgcaagttgttatgttggcttttcccccctttataaaaaaaatggtcaggaacttggggaggtgcattgaatgatgacagtgtgtttgagtaaagtaaatgaatgcagtggggtaaatccatgcttttagggcataatcccagaggcgacagatttaagtttttaggtacatgcttttattattcaggctggctcttggtactgaaaatgtcttgacaaatgagccagcattcagataactgaaaaaatgaacttctgtgaaatacttctgtttgctttgaaattattcatcactttgtttgggggaccttgccaaattcaaagtggagtattgtgatgtaccttgagcctgatggagtttttttctgtatttaaccaagatcacactttaaaactagacagagaatcatgggtaccttgtaaaaaacctaccacggacgccagacctggtgctgcagacacatgtgttttgtcaggtagatttaagttgtaacaggcagaagaaggaaagcagtttggcttgggtgccaaccgggagattagcaatttgctgatttcagctgttttatggcaacatttataaagttgactaattttctccacagatattttgccaattagcattaagaaacaagagaatttagaaataaacttttgctcttttcctatccaaagaaagtggtcttttgtttttaaaaatctatcatctttttctttgatgagagaaattatatttgaggcatttagttaatctgctattctttgaaacatacacattcttattttggaaaaattaaaaacattcatctctacattcaacattctttaagactggtgggattgtgagttgcagtagtagcagaaagaaaagacagaacgtggaaaaaagccgtttcctttctctttttgttgcaacttctagtcccttgtcatttgtttgtctttgtcacacttgcaggcctttccaacccccagaatctagggtactgttatacataactagaagacttctatgcgccagattatttaatgctcctcattccctttgcatttggtggcacgtctccctcatgtctttgtattaaactgtcagtcaccagcataggtaacacagtacactttaaatttcttgtgaaaatcagcccttggtcacattgtcttagccatgggccaaggccttcaattccagccccacctcaggagttcacagatagtgagtcaatacgttccctgtaattttaagccagctcgacttgcggtttctgttacttgcaaccagatgcacctaatggatcctgattgtaatgaactttataattagattttctgttatgtgttggaaatgaaacagagtaattctcctctcctggccaaggaacttacactcccaaagagacacgaagaaaagtgaacacttactgagcatctgctgtgtgtgctgggtgtttcagagacatttcctcatggaatgctgaagatggccattactgggcctgctccctcttcttgcaggtatgagtgatggggtagaatcggcgaatcctttagatctttactgcattgttgctgaagttatgctgattgtgactatttctgggctgtcaatggatttttatgtggccctgagcacagtgtctcagggaggtagggctatttccagtgtctgagcagaactaatttcacatcccccccaacaaggtatctagggtcacctggtgcgttgttacttgcttttctgctaacctgctttccttgcacacagtagaaaattgggctaggagtaacatactgttctaactataattaaaagaattccccctcattggccaagtgcaagcacatggggtttttacactctcagtcgactgaattacattctaggtgcactgagagtttgctactatgggtgttatcttgttttctgaattccactgggtgataaaatgcaactacagctgtgtccttctgtgggaaggagggagtccagtgaagtcctctgtgccagggctgggagagatggtcatgagggttcttatcctttgaccttagccatgaccccaggctggctttacctttgaccctgcccttttgatgtgcccagggctggtctggcctggctagtagtcactccttgtgtggcagttagctgagggtatatctgagggtgatatagggtatatctgttggttgaaattagctgggatgaaaacatacctttcatcataggccaatggctcattgaaaagaaattagtcatgaacttcactgtcagctgaaaagtagtcattaagggccctcctccaacaataggacacttgttccggtttcagggtcacctgatccacaccaataggggaagactggggaagaatgctgtgcaaaacgttttcagaggttgtaacaggcaggtctgcatttttagaattttttttttttttttggctagctgtatatgattgaacagttttcagtttcaaagttgcaggctttggtgtttagatccttcctaggctggtggtagaagaatcctgggattctgggttagtcctcggcggagatggccaagcactacatgggaccgaactccgggcctgagcagctggcttggagggtgttggcttttctccttcctggtgggtgtggaggcgtgaggggggatggtggggggatggaagatttcagtgagagttgtttattgctaaaggtctacaggagagaagacgatttgaaaggcaggatacagtaggttaaaaaggttgtcctgtacagaacacacccacagaaattgcacacatgtaaggaaaattgtggcaggaaagaagcttggctcttttgcctttcttcatttccgcccccaagtttgccttgaacttggaatcttacgttataaacgttgccaaattgcagctccaatcaggaaacagatggttaggcagtaccagaaaacacaaataattgtggggaccatgaacattagttcatgaacattagaaaaccctgatggaaagtttagaactatgtacattttttttttttttggtgaatatcagacttaaataattgcgaaaagaatggtctagaaatattttgctaggtattagaattttgtggtacagtaaacaattaatcaacttctagtttataaaaaatctgctgtgctgtataattcttaaaaataaatttagtcagtgatggatgcgctgagggccctgaccaccacgaagcaatagatcaggtagcaaaatgcacttgtaccccacggatatagacaaaaaacactaaaagtaaatacatagataaataaattttgttaagcttatctgccttagtttctgtctaggtggctgtaaacacgccctggtctcatttccgaggctttgtacttcctcttttctctcctgggacagctctgcccaatttttcctgtttccaggctttagtccccttctcggcccctccctgaagcttcttctggtgaattctgcagttcattcatttcttcttcttcttctttttttttttttttttgagacagagtttcactcttgttgcctaggctggagtgcaatggagtgatcttggctcactgcaacctctgcctgctaggttcaagtgattctcctgcctcagcctcctgagtagctgggattacaagtgcccgtcaccatgcccggctaatttttgtatttttggtagagacagggtttcaccatgttggccaggctggtctcgaactcctgatctcaggtggtccgcccaccatggccttccaaagtgctgggattataggcaggagccaccacacctggccctggagctcattcatttctatttgtttctgaaagcagggactctaaatattactaaccccattttggctcctagttgtatgcttatctctgttagagaagactcttgaaattatctaaggaatgtaatacttcatccagttttttaaaactctagaaagctagattctgcagcttcttagtagcctataaccgactcttttttttttttttttttttttgagacggagtcttgctctgtcacccaggctggaatgcagtggcatgatctcggctcactgcaatctctgcctcctgggttcaagcgattctcctgcctcagcctcccaagtaactgggattacaggtgcctgccaccatgcccggctaatttttgtatttttagtagagacaggttttaccatgttggccaggctggtcttgaactcctgacctcaagtgatccgcctgccttggcctcccaaagtgctgggattagaggcgtgagccaccacacccagcctataactggctcttacccttactgtcgttaggctcttcctctgactctcggctcaattaaaaagatgaggtaaactttatacacaatcccttcatgtatatttaaggaacagtgatgtctccttttaacttcacctctgcagaccaaacactacagattccgtcaaaacctgttacagcatgctgatgtttttcaatctccaataggagtattagtcagctattaagaatattttgctaatttgttaccaaatatggattatccatggcgatggtctacctgaaatttcccctgtgaaatggacatggttcagtgagtttgaacattgatacactcagttcttaatcgtctttctaaattcagtgacagttctttttttattgcctaataaccgcttgcaagaagtcaagtccagactcttcctgattttgtaggagcgtttgtgctttgcaacctgccccatgattatggtgtgacctgtcaggattcccttcgtggttacttagcagaacgcttaggtctggcatcatcaaagaatgtctaactctgcttggtaatgatgaaactggtgggggtttttgaattactcttaaaaagttatttccccaggtaagttcatagcctggatatttccccacataaaagatcaaacattccttaatctcttctctatatcccaccctttaagaccttcaggttagagaggagacattctgaaaaaatccaaatgcaaacagtggtatgtcagaagaaatggtttcaagtggtcgcaacagagaaatagcgttggcaaggcgggatcggggctgatgaaaatgatacaggcttttatatttctgcaggagttttttttttttttcattccaagcataccagagtttcaccaaagcaggtagaaagaatgtgagaagggccgggcgcggtggctcacgcctgtaatcccagcactttgggaggccgaggcgggcggatcacgaggtcaggagatcgagaccatcccggctaaaaacggtgaaaccccgtctctactaaaaatacaaaaattagccgggcgtggtggcaggcgcctgtagtcccagctacttgggaggctgaggcaggagaatggcgtgaacccgggaggcggagcttgcagtgagccgagatcccgccactgcactccagcctgggcgacagagtgagactccgtctcaaaaaaaaaaaaaaaaaaaagaatgtgagaaggtgttgtcacaaaatccaggcatgagtgtatttctcctccttagagccagcctcttctggcaagccattggatctcttcaagcctcagcttctccatctatagaatggctacagcagtgttacttgcttcccaggagaggagcattccatcagcagtaaagcattcattgatcttccttttgtttctctgtcacagcctggcatggtcccaaaatattgtagtaatcaatgtgttttgaattaatgggtttctaaatattcccatgcttcacacagaccgttttggatctctgaagttttgcaccgtgcagcctgttaggcagttgatcaacctgtgactaccttgtttgtggcttattttccccagccagagcagcccggatctgctggcaacctggcaatctttgttgtgagaggttaacacaattcctacagtctgcacaagcaggaggtggagtggaggtgggagaggtgcggagttggaatggctcccaggctgccgtcttggctcgtgtgagtcagtggcatggaacacgcaggttctgtgcatttatataagggaaggaaggctgttggctctacattctatatattccccagttgtcgctcagaatagtcatgaagatccgtgcctattccatgttcttttggtcttacaatgatagtcatattaggcaaagagaacacaaagtctcttgaacattagctgcttgccttgaatttcagtgtgacgcattcattcattccatttattcattcaagaagcaatatttagcacttactctgtgtcaggtactgtgctaggaactgagattcctacctcaagaaacttcaagtttacagtggaagagacaggtaatctttgtgatccaaggttactgaagcagtgagatgtgggccaggtgctctggggaacctgtggatgagccaagaatttccgatgttggggctggggtggataggaaggatgcacagagcagaagatctttagagtttgatgcaatacagtgtcgtggagaggaaacatagtgtcttgaaggagagcataggtgagattgaattctagctcctcttcttaacaattacgtgaccctcaggcaagttacctattttttttttttttgaacttcagctttttcatctgagaataggcaaagaagataataagataataatgtcctaagacttcatcatagtgtctggcaaccaatagatttttttttttttttgagacggagtctggctctgttgcccaggctggagtgcagtggcgcaatctcagtgcactgcaagctccgcctcaaggttcatgccattctcctgcctcagcttcccgagtagctgggactacaggcgcccaccaccacacccggctaatttttttgtatttttagtagagacggggtttcaccatgttagccaggatggtcttgatctcctgacctcgtgatccacctgcctcggcctcccaaagtgctgggattacaggcgtgagccaccgtgcctggccaaaccaatagatttttaattaattaattaattaatgtccagtaatagtttttaaatatgttaattaattaatgtctgtctgttttcaatctcttcctcttattgttcctcacattgttactggaggcaaattattacaatagaaagaacactagaattggctctgccaccagcctactgtgtgactccagggatgcagagctagtcacacctccctgtagacctcctgtgggatctgtgaggggaaagatctgggttgacttgtttccagtttttggctattaagagtaatgcagctacaaacattccctacaagtctttgtgtgacatatgttttcatttctcttgggtatacacctaggagtggaattgctgggtcgtatggtaactccatgtttaaccttctgaaggacttccaggctgttctcacatggctgtaccattttacaatctcaccagcattgtgtaagggttctgattcctctccatcctcaccaacacttgttactgccatttttttttttatctgagccatcctagtgggtggaaagtggtatccactgcagttttgatttgcgatctcctggtgactaatgatgttgaacgtcttttcatgtgctttttggctgtttatcatagcctttggagaaatgtctgttcaaatcctttgcccattgtgagagtcattgactttggtatttgttgtttggactctccttctcctggcttgtggagattgctttatcctctgaggttgcaccgcagatcctcttctgcaagtcaatgggtatggttgtggtgtagcgggtttcagcagcaacagtggtctgaggaccactaaaaataaacataaggagtgtcactacgttagcagcataggctgttttatgctgaaataacgtctcagtggcttaacacattaagcctcatttcttcttctgcaaagtctatgctccaggctgctgcaatcttagggcacgactctactttctatgaatgtgaacaatgtgaggggactcaggggctttttgatgcctcagccattatccagaccccatcacatggccccatacaatgggaagggatctgggaagtgcagtcttccatgtcctgggaaggggtgacctggtattagtgagcatcagcagtgtccatcgcagtcaccgtctcccatttcgtggcagggtcagtgacttctcgtgacagcctcatgaaggtgaaaaagcagggatactattagacactctgatattggaaatctcctagttggctcagtggaactacaaaacttcacttagggacactaagattcatctggaatatttgcttctaatttgactatacaggtttggtacaccttggaatggattgtcttttctgtcttttatataataattccaggaagacggtgttttgagttcctactgtgtgccagtattgtactgtgtgctgcttatacaggattaattagagcacatccctgcttcttaggactcatacacgtagcactgtacaagagtggggataaacacatagactgacatctatgctggtgagtgaagattagtagcaggaggaaagacttctgggagcagaaatgggggaatccttggagctttctcggggagtggggaagagcatcccaggccattccctttatttttaattgtggaaaaatatacataacccttcatatagatcatttaaatcattcataagtgtacaattcagtaacattaaatacattcacaatgtcatgtaaccatcaccaatatctatacctattaaataagaactcccatcccctggcaccctttattctacttgctgccttatggagtttcctattctaggtacttcctataagtggaatcatacagtatttgtccttctgtatctggcttatctcactcagcatgctattttcagagtccgtgcttttttttttttctttgagatagagtctctctctgtcactcaggctgaagtgcagtggcacaatcttgactcactgcaacttctgcctctcgggttcaagtaattttcctgcctcagcctcccacgtagctgggattacagacgtgcaccaccacgcctggctaatttttgtatttttggtggagatgaggtttcaccatgttggccaggctggtctcgaactcctggcctcaagtgatccccctgcctcagcctcccaaagtgctgggattacacatgtgagccaccgcacctggcctccacgcatgttgtagcacatattaaaatttcattccttttcaaggctgaataataaatactccatcgtgtgtgtataccaaattttgtttatctgttcatctgtggatggagccttgagttgtttccactttttggctatgatgctgctgtggacgtgggtgtgcagatgtgggtgtctgttccagtggcactcacttttttaggaaaattttaccttgagttctgagatagcacatattcattgtggattagttagaaaaatacagaaaattaaaattaaaacagaaaatcaccgcttttgtatttagtgataatttttacggtaaaaatatgttaaatttatctccttttttctctttaaatatttcaataaatatattgactagatttttagtatttattatttttattatttaatttattgaaatatttaaataattcaatacatatattgaaatacttaaataattcaatacatatattgaaaaacttaaataattcaatacatatattgaaatacttaaataattcaatacatatattgaaatacttaaataattcaatacatatattgaaatatttaaataaatgaaatttgttaaataaataaatacataaaatatttcaaatatttttaatgaccataaacaatacttttatgggtgtgtcttgatttattatttcattacttttagatagttttgagatttattataaattacatcgagatgaacatatctatataaatctttgttgataaatctgttatttacataaaaatgaagctactacatcaaagatatgagcaaatcaagttgcttatcacaaatggccgattactttgtgagagttttgccacagcctcgccagtgtgtgagtccccatgtccttaaagcagcacagtaatgctcttgctcaaaactgtgcttcccattccaggggttttggcctctctctgcagcccccacttggggcacccattgtggatgggtggagactgactgttgaggagagtgtgccttgtttagttatatacaagtggctctcaagcctttgttctgcctccacctcctccacgtggttacacactcatcaccagtgagtctcatttcttgcagaagtcttcactttggagagaggtatatatgagcagtttctggtaagcatttgagaatcactgattgtgctagccagagaaagagaaccaataagatgcagtaagatgtgtgtacacacacacaggtacacgtgcacgcgcgcgcgcacacacacacacacaggtacacatgcacacacacacacacacacacagagagcaggccaggttggagacccagggaagagtgggtgctgcagatccaatccaaaggcagttggctagcagagttccctcttccttggaggaagtcagtctttttctcttaaggcctttgattggacgagggtcacccatatcatggaaggtaatttgctttattcacagtctactggctaagtgttaatgtcatctgaaagagtcacagagacatctagacatctaggtgtcagatcaaatatgtgggtaccgtgacctagccaagttggcaataaaattaaccatcacactgatccgaaaagtttgggtgccactgactttaacgttctcctgcatataggcaagaattaaaacacacacacaacaaaagtttatttttactctgaaccacttgagggcaccatgaacgagggaaatggaaagttgtggctcatccgctgttccttttagaacaaccagcattagtactacaggaaacctgaggggatttctccatgcgagtccctaattttgcagttgagaaagttactgtgactgtgtgcaagtctacagggcaaagtaatagagtgagtgaatgaggccagaacgcgaactgtgtcctcttgactttgcatttcatgttctttttcggacattctgataatttctattaattaataatggaaagaatttgaaatatatgtgagttgttttggttcccataagttacatatggtgatgtggcacctaatgttgtgcagattgcatgagtaaagaatccatttaacttttaaacatcaattatgaaatgataaactttcggatttacaaatattgttgatactgagtctgtagcgagttttggccaacgctctaagggttttgtttgttcttccttttgtaaaatgttgccttcgagtaacacaaaggcctgtggtctgtgaacactcagcgtgcaaggatttctttgtttttcatggactctgtgtgtgtgtgcgcgtgtgtgtgtgtgtgttggttgtgggggcaagaactaggggaaaagggatgccaaaaaatgtaagcatgtagtttttctccgctttgttgtgaaaacaaaattgataatgtaacttttggaatcaagtcttttgtatttagattggaacgttctaataccttattgttacaaatagacaatgtgtctgaaaagctgaatttttgagagtggatggattatttaaaataatgattcttaacccatttgtacaattctgtgttctgttacaaatgtcttttctttgtccatgtaacagtcaattcctgttctctgaaggaggaattctctcggtaatttctgagcccttctttaggtggttggccaccagggggcaagcgaagaatggcagaagccatctgacgtagccccttcatcactgcagataaactggtgatgctttcctgacacacttaatggcaaccagaggttttctgcacgtttgtgtttgtgtgtaagtgtgtggggtgagtgtgtggcagtggttatttgctgtattttgactgcataaaattgccatgctttcccctcggtctcctagaaatccttgtaggataattataacacaagaaacagatttgatggaaattctcataattctcatactctgaagcttagctcatatgcatatttcagacttgccagagcccctcttcagtggcttgagacttggtcttaatctttttgtctgactacaaaaaaagttcagtgatgtggttagtgtgttcttagagacactgcacactgtggatctgcgggagagagtttcactcattgtattctgttattttttttgagacagggtctcactctgttgcccaggctggagtgctgtggcgggatctcagctcgctgcaatctccgcctcctgggctcaagcaatcctcccacctcagcctcctgagtagctgggattacaggtgcacaccactacatccggctaatttttgtatttttagtagagatagggtttcaccatgttgcccaggctggtctcaaattcttgggctcaagtgatctgcccgccccgacctcccgtgctgggattacaggcgtgtgtcaccacgcccggttcagttttcatcgtagtatttatttatttatttatttatttatttatttatttatttatagacaggttctagctgtgtggctcaggcttgagtatggggtgtgatcatagcttactggagacttagcttcctgggtagctagtactataggtgcatgccaccacaccaggctagtactgtaggtgcatgccaccataccaggctaattattattactattttttatttttagagagacaggaacttgcactgttacccaggctggtcttatattcctgacctcaaaagatgctccctcctcggcctcccaaagttctgggattacaggcttgagccactgtgccacgccgtagtattatgaaatcatcagaacccttggtagcgtgcgatttcttcctccatctcttgtgctcagcctgcttcttattttaaaatgaggttcatttgtaagttgccttgctcactatttttgaacatttaaaacaactttttagaataggtaagaagttgagaaaatagagacagaaaaaaatacacagcttattaaggcattccaaaatacatgccagatgattatacagagcaactcttattttaggaatttcttattggatgaatgatgaaatcaaatactaagttggctttgcataatcaagatattggaaaatagtgggtaaggtaaatgcttatggtgggaatttaattttcccatagagtcatacaatttgaaagagtcatttatatgggaaaaaaaaacttgactgtggaattattaataccagccttactttcagcaagggctgtgtccttgccagtgtgtggcttaagtaatgaatttcctcatataatccctgtaagaaaagttagatggataatgaagccacttgatcctttcatgctcattgccacatatattcattaaaatatcacacaggtaattcctcatttccctagtagctcttaccacctttccagatttgagtgttgaagagaccagtcttcttactggctgccccaggcattcagcaaaactcagtctttgtaggaatgtcttagatctgcttttttagatggaacctagtctatatcagtttactagttccatacgacgtggctaaactcatttttcagatgctttgaatggagtatagaagactattgctttactaaaaaagcaaacatgaaaacttcaagcctcacagtcagctcctatcaatttccctttaattacctcctcaagtacctgttaatggctcattagttataaaaataaattataggtactctgccaccctgtttgtagtttctttagtttttgatttcgctaaccccaggaaaatggatgtgtggcaataatacaggaatgtgaatcaaattgctctgtaattttatatatttaataaagtatacagcagggccgtgtgcacatggggttaagctgtggtggaggaaagtgctctgtgagaaaactgaagtcctcatacaccatgttggctgcctatgtttcatttcacgacatagtgctcagcaaatagggctgattggttttcagtccggttttgtgtggttttaggttcataatggttccttttcatatatggcctttgaaacttgcttgacactgcagtcatctctcatagataaaataggtcacagtgagttttaaattctttttttttttttttgaaataaaaatgttattcaggccgggtgtggtggctcacgcctgtgatcccagcactttgggaggccaaggcgggtggatcacaaggtcaggagttcaagaccagcctagccaagatggcgaaaccccatctctactaaaaaatacaaaaatcagccaagcatggtggcaggtgcctgtaatcccagctactcgggagactgaggcagagaattgcttgaacccaggaggcagaggttgcagcgagccaagatcgcgccaccgtactccaccctgagagacagagcgagactccatctcaaaaaaaaaaaaaaaagaaaaagaaaaagaaaaagaaaaatgtttttaaaataaaattgcaggtggtatcccaatctgcaaggataaaagcagaatgactctttttgggaggagggagaagaatctcagaaccttggccacacagttcacacagagacgtcaccctgacccgtaggactccgcagaactcagtgtgaaaaacaccaaaatagaagatgaaatcatttttatgcttaagtactaaatatttccactcaatttttagacttgttcagccacaaatgtagacagaaacattgtgtaccttcctgggcactgaactttagatcaggagttggcaaactttttccacagagggctagatagtgtatgctttcgactgtggggccatatggtctctgtcaccactactcagctctgctgccgtggcacaaaagcagccagggacattatggaaatcgcatgagcgtggctgtgttccagtaaagctctgtgcatgccaaaatttggattccatataattttcacatatgatgaaatattgttttgattttttctgattttagcaaaaagatactctcggctctttttcttctttgagttttagttattataaaggtaataccatgaaagaacatttcaaaaggatgagaaactcatctttaattccataatccatgttcttttcttcatacgtcactgtatcttataataattgtaattatagttgacccacagttctgtacttttgcttttacttacttaattttttatacgtaaatcatagtttatgtagtgtaggtgtaaaattctgaaaataaattatgtttacttttctttaatgttacttatttaattgcatctactcccagtgttcttctacccaatccgaatttctaatctttttaaaagcaatctaataattgtttcttaaaaaaacaaaattattattcaatttggtgaatttgtatttgttggtattctggaatataaatctctgaaaaagggacaccccattgcaagtagatatgaggatggcagtcattttcttcctccaacccttaacactgtcttggagagttcccatgttccggttgaatattttggtactgaaaaatgtcttcaggaaagcaacaattgttttcctagaaaaaaaacctgagaactcatttctctctttaggttgcctgacatttgtagctgagtgaaaccatggtgagcattgatttattttactataaaattatcagttttactcactcaaacaatccttttatattaaaaatattttaaaaataaaagcagggtattgttttgctttactaaatggagtcacctctttttctcttacttttgacaatttggttgtcaaattgtgtgaattgtgaaaaaatagccctgagtacagagaatttttacctcagggatatcaaaaaagtcatgttagtaataaaataagccattgattgtgttaaaactcaaggtgggtcatttaattgcagttattaaaaagttctttcattatttacctctgggagagactgtaggtaggactgtaagattattaatgaaaatgcgtgtagattggtttaaatgattcagcttcatctcaccaaggagttagcatgttcattcattttacaaaagtgtattgagcacctcgcctactatgtcttgagtaatttgttagacatacaaagttgactaaaacatggactctgaccccaaggctaaaatgttatttcacatgtgcacagtgctttacagattacaaatgacatcattacatcctcataagaatctcatgaagcagatgttggttccatttcattcatgatgaaactaaaacatagaaaacataatagtctccccaaggctgcctgtagcacagttccttagattcccaatcaggtgacctttccaaactgtagagatggctctataatagtttaaaaaggagagataagaaatgtccaccataggtaaatacaaaatagacagtaatacgtacaatcacagaagttcagctaaagtggtacaggagtccagaagacggagagatggcttctgggtaggggatggataaagggcataaggactagggatagggatggatggactgtgcactttcagggcaggggaagatcattccatccagagccggaaaagcttcagaaaagcttaagccaggtgggatatggcatgggaagaatggaaataggaacagtcagtggttcaatttaccttgaagatagaatatatcacatggaattattagagatgaggacaaaaagatggaaaagaaacacatcttccaggtctttgatgccaggccataaagcttgaatttttttttgctggaagtggagagccatctgaggcttctaagcagaagtgtgctaatctggcagcagttttgaacaagggagttgcaaactcacatacctgtaaaggccatgaagataatagagaagtgatgtggagaggatacagcaaaaagagaagtattctccaggggaccatccaccattcaatgctttgggaatgcaatctctcattctgctgcagatttacagttctcctctgcatatgtgctttattaagttacatctttatacgatgtgttcccattgacatagatttgtaacttttatgtggttatgttttaaatcttacagaaaaaaggagttaatagtcaaatatactttaatactgacttttatatgtacttatgtagtgtacttataatatgtacttaacagtgttctttatttcttcgtgcatattgaattattgtctagtattttttcatttcaacctgaaggattttttgtagggcaggtttactagtgacaaaccctcttgagtttttgtctatcttggaatgccttaatttcttcttcaattttgaaggatagtttgctgaatataaaattcttaatggacagtttgttttctttcagcactttgcatgtcatcctattgccttctggcctccgtggcttctgatgagaaattaactgttaatcttactgtgtataccttgtgacaaggctgttttctcttgctgcttccaggattctctttttgtatttcgacagttacattataatgtatcttgttttggacttgtgtgaatttatcatgcttggagtttgttgagtttgttgaatgtgtagattcatgcttggccattattgcttcaaatattcttttgccctttttctctctcctctctttgtggaacatcacgttggtgtgcttgatggtgttccacaggcctctttggttctgtttatttttcttcatgttttaatttttgttcttcagattgggtaatctcgattgacctatcttcaagtttgctgattctttcttctgtctctttaaatctgctattgaacactgaagtttgcttatggtacttttcaactccagaatttctttatggtttctttttataatttctgcgtgtttattgatattctctattttgtgagacatcattctcatgatttcctttagttgcttgtatatttttttcttaaagcatttcaacatatttaaaatagtcaatttaaaatctttgcctagtaagttcaatagcttcctcagagacagtttctattcatatcttttctttttttcctgtgcgtgggtcatactttcttgcatgccttgtaattttttttttgaaactgggttttgaatattgtaatgtgataactcgggtagtcagattctttctgattctcaggacttgttgcacctgcttattgtggttgctgtttctttgtttagtgacttttagaaactaattttgttaagttctgccttctttgtcatgtatgtccatggaagcttatgtttggttagcttagcaatttgacaaagattccctcaaacatctggaacaaaaacagaaaaaagaatcagagagccagtgtgctgtgtgtattaggttatgccttcaaccctcagccatacaattcccaactctgccttagccttcacttcctgcttgtgcagagcctgaaagtcaggcagaagtgagagctcagtgccatctcaggtctattctgagcatatgccctacctttagcatgtatatgggcttctagaatcccaggattacatgggaacttttcaaagtccttatatggaaaagtatgtaactccctagcctttccttttaggtttttttgctatctgttgtttgccccaatttgtatttctttgccccaggtgtcagcaactaagtcatgtgtttttaatgagtgacaaatgtttattgggtagtcacttcaccacccagggaaagttctgaattagcaaaaataattcagaacatattgccttttctatcagtccttcagagccaccagacaggttaaaagaaacacaattattggaaagcaagatctgctctccttccagcactaggaaccatcaccaagaaagtgggttgctgtcttcaagaccacaatcgaactggataggaggatcctggggccagggtaggttaaaatgccataaatctcccctactgaaattcagctgcctttttcttatgtgttcacctggccgctgtaaacctgtgaccagttccagagttcagattaagttgattttgacagtttttgtccatttattagctgtttctgtacaggaacaggcccttggaattccctattccacgattttcgctgatgtcactttgtgcacatgtgccttacaaatagtgtgtatataaaagaaaacatgtgtgagctaagtgcaggatgctaccttattacctttggtataaagagaactagagaggagagaggttgaaggagaagaaatgagtaggaaatggagggatattgactggcccagcttcaggcaccaaaacataatacagtcttcctagaaagttatgcagttcaggtatctgttctattaggggacagcgtgtggttgcctgtaacagaaaattgtttcatactggcccacacaaataggaatttatttgactcacataacaggaaacctggggatgaacaggtaagagccagagtagtggcctaatgatgctgtcaagaactcaggtgctgttgatcattctctttcactgtcattagaatattggcttctatattctcagttgttgcctcttgatctcaagatggttgctgtagctccagatagcacctctgcattcaaggcacataatatacaaaagtcttttcctggcaactttttagaacgttggaacagaaagcccccgtcagaagacttcttatatttcattagccataaataagtcacatgttcactcgtatatccatcactggccaaaagaagagattaccatgacaagtctgtgattcttctgtcagggctggggaagggcctccgagagatgaaaggagcagggttctgtaagccaggaagagagaataaccgttaggtgggcagtggacaatggctagatagaagctaagagggatggctgataaggatgtgaggtggctagttggaagggtagcaggtacctgctctgtcctaaccatgtcaaacttggagcaagctgtcatctttattagagaagtgaggagttagaagtgaagattagaaatacaaaacttacagacagtcatgtaatagggttaaaaccagaaatgtcaactctgagccaaagtaagctaaagcctgtggtgtgtcggatgctggaacaggagcccgaagtccatgttggggcccaggtggagggaatagaattctgctgagtgcctggtttctggctctggctcttgcctcgtgggagtttaggttacatttagagctggcaagcagtttccagcaggtgtggcaatctccaggcccttagataactagttcactctgggcatgtacacagtcttgcaggggctagtagattccaagcatcaaactagagatgggagaaggacaatttagggccaagtggggaaattggcaagagtcccaggcccaggagcagccagatttcctgggcagttaccaaaattggagcttggaaacaaggcttaagaggtgaaactctgttatttagggttggaggcaggctggagttggggaattaggagctctttgactaaaattgagactttagggtggaactagcagccactgctactgggtgcaagaccccagagtgggctgaagtcaaaggcctcatgcctcagtatgggcttgatcctgagcattggaaattagcctcagcctactacatatggatcaggggtttcctgttggggtgggagaaggaaggatgtagcttcgtaggagatacatacaagaactcttttggagatagcatttacagggcttggaaagaagacaatgctggagggtgagcctagctggctggctttatctaaaatgtggaatacagaaatagtaataattgttgacgttaaacgtctgagcctatgagtacatagggcatctagggagagatgtcagtaattgattatatgagattgggatgtgggagatctctaccaagatctctacagccagaaataaagactggagccatccacacatcgggatcaggatggagtgagattgcgaagggagagggcgttgggagttcggcacatcgtttttgtgtatgcaccatgaaggagaagccactccaagggttgtatttatttccatttcattttattgccccatgatttttttcccagattcctccaatttctggttgattcttctttcctaatgtttttcagatataaccagtttctcccaaatagctgcattttcttttttcttttctttttctttctttctttttttttgagatggagtttcactcttgttgtccaggctgtagtgcagtggcaagatcttggctcaccataacctccacctcccgggttcaagcaattctcctgcctcagcctcacaagtaattgggattacaggctccagccaccacagctggctaattttttgtatttttatatttttagtagagacgaggtttcaccatgttggccaggctggtcttgaactcctgtcctcaggtgatctgcctgcctcggcctcccaaagtgttgggattacaggcatgagccaccacacccagcctgcattttcttaaatgctcaaaaagtttatatagattcttcaaggagaaaaaaaaaattttggagaatgccatattttccatccttaagacaaggatttgtgcttattattctttatgattttcatttatagtaattgatacttatgagatttctttttaaaaaaagtcaaaagggctgggcatggtggctcacacctgtaatcccagcactttgggaggccgaggcaggtggatcacttgaggtcaggagtttaagaccagcctgaccaacatggtgaaaccccgtctctactaaaaatacaaaaattagctgggcttggtggcaggtgcctgtaatcccagttacttgggaggctgaggcaggaggattgcttgaacccaggaggtggaggctgcagtaagccgagatcacaccactgcactccagcctgggtgacagagtgagactccgtctcaagaaaaaaagaagaagtcaaaagaagaagaacatgttgccaccttctcctccattctttcatcatgtgacaaatgggagaaaggatgagggaaaggatgagagaaaggatgagagaaaggatgagggaaaggatgagggaaaggatgagagaaaggatgagagaaacgatgagggaaaggatgagggaaaggatgagggaaaggatgagggaaaggatgagggaaacgatgagggaaaggatgagggaaacgatgagaaaggatgagggaaaggatgagagaaaggatgagagaaacgatgagggaaaggatgagagaaacgatgagagaaaggatgagggaaaggatgagagaaaggatgagggaaacgatgagggaaacgatgagggaaaggatgagggaaacgatgagggaaaggatgagagaaacgatgagaaaggatgagggaaaggatgagaaaaagaatgagagaaacgatggaaaggatgagagaaacgatgagggaaaggatgagggaaaggatgagagaaaggatgagagaaacgatgagggaaaggatgagagaaaggatgagggaaaggatgagggaaaggatgagggaaaggatgagggaaaggatgagagaaaggatgagggaaaggatgagagaaacgatgagggaaaggatgagaggatgagagaaaggatgagggaaaggatgagagaaaggatgagggaaaggatgagagaaacgatgagagaaacgatgagggaaaggatgagggaaaggatgagggaaaggatgagagaaacgatgagggaaaggatgagggaaaggatgagagaaacgatgagggaaaggatgagagaaaggatgagggaaaggatgagggaaaggatgagagaaaggatgagggaaaggatgagggaaaggatgagagaaaggatgagggaaaggatgagagaaaggatgagggaaaggatgagagaaacgatgagggaaaggatgagagaaaggatgagggaaaggatgagggaaaggatgagagaaaggatgagagaaaggatgagggaaaggatgagagaaaggatgagagaaaggatgagggaaaggatgagggaaacgatgagggaaaggatgagggaaaggatgagagaaaggatgagggaaaggatgagggaaaggatgagagaaaggatgagggaaaggatgagagaaaggatgagggaaaggatgagggaaacgatgagggaaaggatgagggaaaggatgagagaaacgatgagggaaaggatgagggaaaggatgagggaaaggatgagggaaaggatgagagaaacgatgagggaaaggatgagagaaaggatgagggaaaggatgagggaaaggatgagggaaaggatgagggaaaggatgagggaaacgatgagggaaaggatgagagaaaggatgagggaaaggatgagggaaaggatgagggaaaggatgagggaaaggatgagagaaaggatgagggaaaggatgagggaaaggatgagggaaaggatgagggaaaggatgagagaaacgatgagggaaaggatgagggaaaggatgagagaaacgatgagggaaaggatgagggaaaggatgagggaaaggatgagagaaacgatgagggaaaggatgagagaaaggatgagagaaaggatgagggaaaggatgagggaaaggatgagagaaaggatgagggaaaggttgagagaaacgatgagggaaaggatgagagaaaggatgagggaaaggatgagggaaaggatgagggaaaggatgagggaaaggatgagggaaaggatgagggaaaggatgagagaaaggatgagggaaaggatgatgctgccttatcatactctcatcaaggttaattctaggttgaacgatctgaccacaccctgtacctcggaagcagcattcccttcagccatgggaggttctttttttctgcatttagcggtggaacttttaagatttatgttaataaggaagaggaaattaatttaaacctatttaataaaacgaatggttttgtaagttggtgtaagggtgcgtcagcgtaagtagtagagagtagaaatctataagttcctgatggtcaaaatggtcaagttgttattcacacttgtgattgtagggtatgggtgtcaactgctttttcaaacatagatggcaaatgtgaagaacttcccagaactgaggttgaagctccagataaggtaggcaagtcatttactgatgaacccggggcactttggagtgggaaaggcagtattaggaataatcgcacgcaggaacttttctgggcagagtgggacttacggtcaccctagttctagacctcagcaatggttcccagattccataattcaaggtgaaatgaaatcaaagtaaggcatttcctccttgttctggcatctaagttgaaggactgttctcttctataaaatacaggtggcttaaggtcctggaaatgccgaaaggagattgtcttcattgtcaggcttttcccttgcgtttcaagtcaggtgacagtgtttggagactgtgctgagcggattcagggcccagccccgtgggtccttaatgacttcaatgtgggtttttaatcttctgcccaagtgttatcttacttgcccagacaagtcgttcaccactacaggagagtgtgggaaaattaacactgccagagcaaccagggaagggacgaaatgtctgaaggtagaaatgaattgcattaggatttattttaatgcagcctggaaacacacaactttaaatctctgggctgcttaaggagatcccacacctttccttggagggaaaaagaaaaagaggattgaaaaatatacagactacagctatctttaatgtttaagttagctatcaggaaactcgaaatagtgaatgtaataaaatgttgacagcagtttcacttaacatgcggtaactctggactagaacgacatctttggcaccaaaggaaatcgagagaataaaagcagcagtcgtcaggatttgaaggaagccacagattattaccatctgtacattttacagacctcttacaaaaaccagaaacccaggacccagactggagtgtaagtatattgagctctggggtgtgttgttagatggaggaaactcagaaattggtctgaatttttaaacacaatgcttcataaaacctgactattctgttctggcgatgttagaacttgtctataatctgaaacagcagatttatttggaggggttatttgcatgtctcatgtgggatatcccattgtttcaaacctttactataccaggccttcatacttccacgatttctctgtaaatgtagaattatctgtaaattgctctctgatttcagattgttcttatgtgatgggttgtgtgttctttcctgaagcttgtggaaaggtcatcgtcaaacacatataagtgtcttgaataatgaattggttcatcactaccatagatcacttagcttggacttttctattattcttgagaaggtactttctcatgaacctccattaaatatcagtagaagaaggttttgcccagtgtttatttgacattataacttgggccaatggttagattctctgcagttgaaactcatagatagagactaaacataaaacatgcaagtttcacatcagatgtttttgtgtgtgtctgtgtgttttaatcagggcttatatttgctcagagatattagacctgaactcctaaactctagcccttgaaaaactagattcatggcagggggcaggggggatggtgagtttattattttttataaaaagtaaaagtgttttaaaatagcaagtagtgaataagagaggcccatttacctaaaatgtttacataaaaatagagttacatccatgtaaatgggactgttaggtaaattatttgacatctcatggagaaatagaaactttctcataaatgattttgatatagagcactgaaaatacaatttaatggaatcatttcaacttaaaaatgacaattaatgacagattggagaagtcagccaattatcgcttagtgcttttctatccaacacatatggaagattgcttataaacagggaatgttttttttaacatgcatatgaatttagtataatatttgtcaattcttagctagtttggcaacattaaaatcttagatctttgatacttagactagtgtcccgaatatgaaatgttccatggatagatttgttcattctttgcaacccctgaaatattaatgtttaagcaagaaactcttcaccccaatatttttctttggtaacctaagattcacagagtgatgtaatagagtatttggccaaattaaaatgagggaaggtgcaaataacagaattaattcccacagctgtcgaatacgaggttagcaagtaagtgaaatcacacgcattactttgggtgtttaattctgaaaactactcatccaagtgttcactttgaaatttaattgtgtgtatttgtgtctcttctcctgaagggtgctcttctgttagggcagcccatgccgttttttaaattaatggtgcagattcttttagttcataggctcgtcttgggggagtaatgcaggcatgtgtgaaaggggccgtgagcctttctggactcttgggtcctatctgataaatgattgcttcaatacactaaatgggccccagtgtcctagaaacgttcatatcatttccacatgttcacttccttttcctggaaagtgtaacttatgacaagggtaacttggaaatccaagctcattattggagaaaaacgaatggtcgtctatttggcatatgttttgaaaataacctcagtgtgggaaaatcttttgtgaagtttattatgaatctgtttatagtatacttttcaaaatgtgtatgtaagcatcttaaggcttaagaaaagaaagcgctaagtaggcatagttgatttctcctattgcaaaaatacaagtgagcaaggaagaagactatgcagcggaaggtatggttggaatgatgtgttgaggaatgttaatgattcgtctggaagcgtgcaaatgtggggcaagtgcaggcccttcacttccatcctggcttctttttgaagtgacatttggcattttagctgcctcacgatgctactctgataggaatcttctgcctatggtgcacattcggagaatgctctggccacagctgctctggtttgggtcaggagtagggcaagctttgctgaaggtggcagctgccctggcctgtctcctctgagttcgcttccagcctaggtctcattcctggcctggtggtagcatcttgctgcagggatggacctctcagaaacatcctaagtgcgcaccctggggtctcgaataggctggtcacagatttctaggacactgaggcccatttagtgtattgaagcaatcatttatcagataggacccaagagtccagaaaggctcacggcccctttcacacatgtcgacattactcccccaagacgagcctatgaactaaaaaaatctgcaccattaattaaagaaatggcatgggctacactaacagaagagcacccttcaggagaacagacgcaaatacgcacaaacagttgcaaagtgaacactcggatgagtagttttcagcattaaacacttaaagtagtgtgtgattcaacttacttgctaacctcgtatttgacaggtgagggtattaattctgttatttccaccttccctcagcagtctccatccaaactgaagggcagttcagggatctgccttccaaagccttgtctaaaagccgtccctgctctcagccacctgcccctggctgactgcagctaatggtagggtggttcatgtgaacatcgctttgcagttagctgtctcggactcggaccccgggggatgatagctcccttgcccaagaataatggggtgttttgttgttacagaagaagggaagggagatgtgaaagtgctactttaaaaatagtcttttttcagtagtgtctgtttaatagttactgcatatatattaatgtgtgtagctttattttttttgacacttaccctatgggaccaaaacagtcagctaccaagtcttattgagaatttactttggaaagtcctggagatttggtctgtggcatctgactgaggagagaggacatgtgaagaggcagggagggagatgagtggataattagattaaattgtgtggtagaggctgggaggggtttggaggggtttggaggacaggaagttcaaacaagccttcctctcccttctctagggtaatccttctgcctggtaggattggttgccctgtaggactggttgtcccacaggactggtcatcctgcagaactggttatcccgcaggactggttatcctgcaggtctggtcatcccacaggactggtcatcctgcaggtctcatcatcccacaggactggttatcccacaggactggtcatctcgcaggactggttatcctgcaggactggtcatcttgcaggactggtcattccacaggactggttatcctgcagtactggttatcccataggactggttgcctcgtaggactggtcatcccgcaggactggttatcccgcaggactggttgcctcataggattggtcatcccacaggactggtcatcctgcaggactggttatcccattgaaggcagtgccacggctgcctggattcccagccttccacatactgacatgtgcaggtcatctccgaatttgaggttctgcccgattcagcttcttaatctacttatttttcctcttctccacataacttaaaagatgttctgctttcattccttttatcttgttaccccttacctctggggtccttcccacctcctgaatcccgggcagctgtggaatggaggaaccttccccccagccctgtctctttctcctccagctctgccccagtgctgctggtgtccctgtctgctttgcagccccccttccttggtttctggaaagctgctctgtccttgtttgcatcgatgctgttggcggcacagctccctcccatgcctctgagggtatccccaggtttcagtcctgcccatccccctgttctctccctgggataatgataattcatccactcttctctccctacaggagtcagtcattcacttctcaaacatttatcgagtgccttttataccccaggaactgatccaggcattggagtagaaggatgagggcaaaaactgggtccctgcctcctggagtccacagtgaggagcgggtagtaaataggcctccccagcacagctggaagggcaacccctggggaagtgcaggctccctgggggaccctcagggggcaccatgcctgacctcactgcacagccccatccctaagctctcccttgcccctccgcctcccggatgacctatccacacttcagacaaagcagctccacagggaaacccacaatctgttcctccaagctaagtgccctgctgctggcccattcttgacactgtgacctgcgtctcccgccctgtgcgggctgcaagcctgggagtcccactacagctctagtttcccttcagatccttacccagtcagccacccacccggcagctcttctgctgtcgttgcgctcagctctgcttccgactttccattcctgttgcctctgcccacggccggagcctccctgcctcattcgtgcactgtttcgtatttatagatggggtatttacttcctcagagatttaaaaaagttacccaagtggttcatgttcatggtggaaaataattagaaaatagagaaaaagagaaagaaggaaggaaggaaggaaggaaggaagggagggacgggaaaaccacacatttcaccattcagataatgtccctattgagctgtgatagttatccctctagactttttcccgtgtatctatcaaaatatcctcatctatccaaatgtgaaacatgtcttacaaatcatgattatgttatctatattgttttgtagtcgacttctttatacttagcttctatgattgcttttctggatctagaaatataatacttttttttcatggctgtataattattggaagcaatttgccccttcatctctacgtcatttcagtgtactgtacacaccgcccctaagtcattctcacacttgattggtcttgctgcccttctgctgaaaagcacaggcagcttcctatggccctctgccacccgccccacattcctcttctataggaaaggttttatgcctttctcagtcttcaggattctttctctcctctgaataagatctattatttggaccaagcttggtggctgtcataggctacaccttgggattaggaggggcagttcctgggatcccacggtgccttgctcatcgctgtgcccctgctctggcccattctctctctccctcttcccagtgttgtagggtgtcacatgctgccaggtcttgggactgaagaggtgaccaaagtgcctccgaactccagctcctaccgcagtagggcagatacagccatgaaaacagacaaatgcaacagggcaagatcacgacgctggggaggaagaaagggtgtccatcgggtgacattggagctggtcttgccctgtgacaggcacctacagagctcagctggcagtgaccaaagaggatgacagcaggcatttcaggggtggcagaggggactgggggcagtgggcagcctgggaagggcaggggccagatggtgggtgttggtgtggcttggcatgacagaggcggcggggccagggtatgaacaggcttacggagccatctccacccacccacaggacagttttgatgagacaaagcaaatggtgacgcacagaaggccagcatggcccttgcatgcagggaacttgttgttgaaaccaagataaatttctgtatttttatgattttgatatcacaagtcaaatcctgaaacccacatgtcactgggatgatccaaatgatcttaccgaactgaatggatttttttttcctattataccaaagactagaaagacttttgatatctaggactttattttccttgtcacaatattctgtatattaggatttgttcatgtcagttgcgtttactgacagattagattagattagattagatatttactgacagaatttcctggcagattagaatgtgtgtgtgtgtatgtatttgttagtatattaaaactagtcaaaaagcctctttgctgtttaaagataatatataattctgcaattaaatatctgtgtccctttaaaatcatattcttttttttttaccgatgtctacctatttaggatgtagttcactgtgaatttttaaatcaaagaaaataacttcttccagtttttgtaaagggagatgaggaatgatttaagcttcacaaatagaacatagtgctttaaactgtgagggacttctcactgggtccagcctcatcattatacagaaaaggaaacgggccctcaaaagtgaagcaatttgcctaaaatgacgtagctaattagtggcccagccaaaaccccaatccaggacttctggctttcagtgctgtgaccttcccactattccatgctgccagctggcttaaaacaaaacaaaacaaacaaaaaacaaaaaacaaaaaaaaaaaaaaaagaagaaaaagaagaaaaaattggagaattgagttgacacattgcttgaattcccctacctctttatagagtgtgaaaaatcctgatatgctttaaaagaaacacttaaaaatgtatcgggacttgtaaagaaaatcaggaatatttgtgatatgctaattagaaagtatctcattatgcgagagacaggaaacgtggcagagggagatgctattcagagtaacttaaggaaacttcaaaggtaagacaaaaggccgttctttttatttatttgataatgtttgtggctgtcatcaaagttctgatggggcctgacacctttatgaaaaaccccctgtatgaaaaacactgggggaatctctcagacacacggaaggaaaagcaaacgattccatttccatccgagtttccgtaggtggaagacagcctttcccacagtgctcgcctgccaagcatcttcctgtaggaacttgtcagtgccgccattagttgtttgcaaagggattacgctttggcagccatgctaatcgctccaaggtgaccctttatttggagaaacaaatccttttcagttgttgttacggtacactaatccaaccatgcaagtagctgtttgggaaaaaaattatcaaagtgcattttctccccactacttctttctctccagatcgctcctaactaaaagtgctgtttcttccaaagaagttcaaaatgacagggagaaaaacacagaacctggtcagatttcaaattcaggagcagacaggaccccctagatctcagaaggagctgccccccaccactgaggttcaacaaaacccccaggtgggagtggactgtcccgttaccttgggggggtcctcaccctgctgcagtggggcccctgtctttgtctggccattgctgctgtttgccgccatggtgaagtttgttgcactgtaatgttcatagatacccaggaagagggagaaccggggagctttcagcctctcagcctgcgagagcctctagggagagacaaggacacctcaaaataccagttctgacgtgagaagcgactttcaggcagggttttgtagatcgtgtggattttggagttggaacacactggcttgggattgcagttttgcatcttagctgtgtgaccgtgaacaagtcacctggtccctgggcgccgcagcttcttcatctgtaaaatgggttgtggtgattaccggtagggatgtttggaagacacaatgcgacaatatatgtaaagtgcctcgcagggcgtagggctcattgtgggtcctcaaaaatagtagcagttatcatttttcctatatttatgattatctaaacgctaatataccaacaactattttagtttaaattaggacccggaagagcccaaatattaatttacagctcagtggatgattcaaagtgcaaagccccacgtaaccaccatccaggtggtaactagaacattacaggatcacaggagcctcatccctccccgtccacacgatttccccttcccttcttaccgaatgtagccattttcctaaacttctaacactcaacagatacttcgtgagggtttcctagatcccaggctctagaccacacagttcttgccctagggagcttaggtttcagaggcaggagccagacaacaaaagcatatgagaatgaggggatttcagataacgttaagtgtttgttgttgttgtttgtttgtttgtttgttttttgagacagagtctcactctgtcacccaggctggagtgcagtggcacgatctcggctcattgcaacctctgcctcctgggtacaagcgattctcctgcctcagcctccctagtagctgggattacaggcacatgccatcacccctagctaatttttgtattttgagtagagacagggtttcaccatgttggccaggctggtcttgaactgcctacctcggcctcccaaagtgctgtgattataggcatgagctactgtgcccagccaatgttaagtgttatgaggaaaataaaatacccgaatgggccagaagacagctgtcagagggtgcctctacaagggtgaccagggaaggcccttctgaagaagtgacaatgggaagacccagggaggagctgtccatgggagggagcagtgggaggcccctgggcgggagaggctggcacgcatttgagtggcaagaagaagccatgcgagagtcggcagggtttacaccctgagggctcgatacaggctttgggggcaaattgcgttttaagatcaagggtaattagtgtcctgagaaaaaccaaggaaactcagaagagggagggatcgcgccccaccacctctctctaacggtgccctgtgggacttggacagtgtggtttccttgtaaacacagggcctccctggaccgtcactaccacctcgtgaggcctacaaggaaggcgtggttatttccggtcagacaggaggtgacagacactgggagggcctaaggcttgttgcagaactccttttaccacaccagggagcccaccaatctcactggggatgtttaggttgctcatgtcatcgtagttcaggatcttccgacctaagaaacaagccaactcctgcaggaagcaggtagccttgtgtctcccacaaggtcatctgagaacatcggtggcgtacaggactcatgaaagaagcggtcctgggtgagtgacgtggacatggagcacagtgcctcccagccctggagagtcccaatgtggaacgctgtaaagcctctgagaagctctgcagtaaggaaacccatgaactgtgccccccacaccaggccataggagctcttttgtatgccatgtccattgacatctcaaggaatgcaagttctggaggtgccacttggaaaacgccagctgagagagctgctatagagtgtttactaaatgagctcttgaaagagttcaaggattttctgagcctgaaagtcttctctgtgtgaaaggattagaaacaacatttgtaaagcacttccatatgcgtagaatgaagactctggatgaatggagattcaaagtgttgaaaatcataaatccactcctgttttgtacacgaatgttaatttgccctttgaactcatagtgtttccattagtattgcgtgacgattggcttgttcttcgggactctaggatctcaaagcaggaaccagtcttatctggtttaaaagataaatgttctaaaccacacatggctttgattttggattactacctacaaggctacatatttacatagaaaagagtccatttctagattgcttgtaaccatttatacctgttttcatacagattattattcttttaattttttttgtttgctcttgcctagggatttacacaaccgtatctgaacttggaggaaatgtttttgataggtgttcacagaaccactgagctctggcagtttgtggaagagtgtctggttgactttaattcgaaacagaatgttcagacctcttagcaccttcatttctcttcattttccagctccagctccatctgtatttcctccttcattttaactctgtggtccacactttaaagtatgtgaatgttattttttttaatagtctgtattgcctagagttctgcatttcccaaactaggttctcagaaaaaaaagttttgaaatatgaggaaatacagaggtaaacgaggctgtttactgcaggacttctcatgcctttactatcctaacatgcactgttattctccagaacggagataaaacagttattattttccagacttatttaactcctgaatgcctacctcagcccctttcaggaatgttattctgcaaatcctactttggattaaaaaaactaaaagaagagtaatctctatgaaaacaggtgcagatgattacaagtgatgtataaatggactatttatttatttatttttgaaatggggtcttactctgtcaccaggctggagtgcagtggtgcactctcagctcactgcaacctccacctcctgggttcaagtgattcttctgcctcagcctcccgagtagctgggattacaggcgcccaccaccatgcctggctaatttttgtatttttagtagagatggggtttctccatgttggccaggctggtctcgaactcctgacctcaagtgatccatgcacctctgcctcccaacgtgctgggattacagacaagagccactgcgcccggccaaatggactctttttatgtaaatatatatccttgtagataacaatccaaatccaagtaggattgatgctgaagtaagatcaaacccaaacctctcaacttggattttcctcaaccactcctctagcaatgtgtcccactaccacttcacttatccgtcccagcaaaactaattgttttataatcttcccaaaaaacttcaggtttctctacttttaaatctcttcttatgatactctctttctctcctccattcttacccagcaaatctaaaatgcttttctttcttctgctccggtatgaaagatcacagttctccaaatcccagttaccctgggaacaccttcctgaccatcacaatccacaaagaatctctcttagagctgttatcatctgtaccctgccttagcccgtattatgaatatttgctgcctatggtttatcacatatgtactgtctctgctacttgaggctcacacctgtatgtgcatttgtgtgcccatgtgtttaatccttgttaggctttgtacacagcacaaactccattgaatgaaaaaaatagtttatattttgttttgaaatctgattatttattctctctcttcttagatactcggttttaaagtgactggggtgggtgggattgctgttttacctgtcttttggttcatgagttaggcagagactatagaaaaggcatgaacaattactatagaaactgccacaaacatattaagcacatagagggtgtcagcatctatgaataaaaagcccgtattttctctaaatgagcttacggtctgtttggggagataagtattataatacaatttaataaaagaccttgttagtagtatcaaaaagcattataggatacaggaatgaggatggctaatttcaggtgagtctgcaggaccgtagatagaaagaatttatgggatgtaaagaaaaaaattcactgaagaggaggtagtgatttatgctaaaagaataagacagaattaggagtttggatggggaagaggaggtgacggaggttgcaaggaggggaacgaaatggcatgaacacaggctagaaggcaagaaaaccctggttgtaggttgcatggagaagtcttgtggagacaaagacagaatttgatttgggggtcattttttggaaggcttttttctttttaaccacttaggcattgtgagtccattaaaacaacgtttaagctgatgagtggcgtgataaagattaggctttaggaaaaatggaagacggagttgacacaggtgaataaaatgagggttccactgagattgtcatggatctaatgatcttggtgactcccagcagacctgggtatgaggagcagagaaaacccacagcataggtgaaggggagaaagatacacgtgctgatgaacaattgttttcaaagttaattttaattctttgcggtgaaggaataatatagggaggggccttaagctcttgttgtcccccttcaagtggccacccctctgccccttctcttatatccagtgctcagcttatttcaagaagataagcccaccccgagcctgttctttccttgccaaaaaccctaattgctggttttcctagtggtctttctctcccggtttctctcactggcagcctgaagaaatcatattataatgagtgaggaaagaatgttctccatggagaacctgttctggcatcttaagatcctgtttctcctggtgttctgagtaggatgcttcagccttcagagctgcagggcatctgatttaagagccatctgttttaatcaggcattttgcctgatttatgaagaagaggatggtggagggggaggggctgggatatactatattctcccagttagatgagaattactgagaattactgtgccagatcccggcaatgatgtgtttgcattattgaatgtcattgcttttcctttcattgttctttatcttaaagtttcagagcctcttgttagtgtttctaaaacttcaacactttgtgtttttggagctcctagacaggtgccaggcgcagtggcttatgcctgtagtcccagcacgttgggaggccaagacgggaggaacacttgaactcaggagttggaggccgcagtgagtggcaattgggtcactacactccagcctgagtaacagaaggagaccctgtctcaaaacagacaaacaaacaaacaaacaaaaagaacaatgtattttattttgtcaatcaacatgaatagaagttgaagcaatttaccctcacatttgatactccgtgatacaaattagaaaaaggtcatctcttgtttatagttcttttttttttccccctatgagtgggcactatttacatgtggaaggatctgtgtccaagctttcaatcaccatgttgtttcggctctagagctgcctataagcaactgtacagagtttagagtggatcaaggtggtgacatgttcgccctctctattacccatgtgggcacacccagtgtttagaaaatagtttttctctacatctccatttgccgctgtcacttgaggaaattttactaaaattcagaaggttttgaaactcccagattacctttaaaacttagggagactggttgcccagaggataaacagagatttcaaaaatatgacatggaagagagggtgaaaggctggcacttcttaagccgagagcccgaggagaaaggccaagatcgggacacagcagatacgtttcctggacagggctgctgagggaacgttgccagatgagctttcagcgaatgctgtgtttcatttgttcttggtcccttcatcattaaaagcatattaaagtgtcatagtcactcggagcagtggcccaccccaccatgatcctgctttaccgtgggacatgaggccagagatctgaggttatccatcgtttgtcatcctgagaaggagtttcctttaataagtcggggtatatttcccttcctagctcttttcccatatagttaattcttggcgtgtgcaatcacttttagtctattagtattaatcgtgctcccttgctgctccaggctctgtgctgggctcaagagacacaaaggttgagtagcttctcctgaaaggtacctcacagccccaagggggaagcagacaggaatgcaattcactacaagtgccaagagctagaatagagcaccggtatggctcaggggatgcagaagaaggaagaactgattgctggggacagtcagaattttccctctgcttttttattcctgtagtgtaaaatttgcataataaagaagcaagttaacatgttgtgtcaacctatgcctctcgaacattagagtgtgttctggatctggggcttgaccacttgctcagcaagtctgtaattgtcctgaaagcctttctgaagccatgactgaagcctctcggtggcatctgaggagaaatgttaggaaaacatttagatggcagttcagtggatcatagaaactactttgctaatacagtttagtgacatttttagaaaggaggccagaataccagagagccatggacaaccatttctttacattgtttctagggccagcactgtggctcacacctgtaaccgcagcactgtgggaggccgaggagggaggattgcttgagctcaggaggttgagcctgcagtgagctatgattgtgccattgcacttcagcctgggcaacagatggagactcagtttctttaaaaaagaaaaaaaaattgtttctctatgtatgagttggataatggaagttacctagatcttcctcaggtcatctgggcatgctggtgaggtggcagaacctgccccaaagacgaatgtcccgacttgagtgaaggttgctcaggtggacttgaaaagtctggggaaaccaggaacagctgattaagcccgaggaggcataatatagcagcactgtgaccctgacggctggaaaaatttagatgctcagtttttctcctgagtgcaacaattctcatgtcttactcgaattcaagacttcatggaatgcagcaagctgtgtatagctcctcgtagcaaaacctcaaatgggtggaaataagatgtccggcttaactgaatgttctagtttattaaaagtaaacccttctgttaagagtaagcccttttattaaaaaagaaaaagggtaagtcactccccacttttcttttgataaaaatatgtctttaatacaatacagtgagtatatccttgaacctttttggtttatttggtgttttgaggatttccccagattcttctgactttgatattactcctcatggtaagacatgagaatgaagctctgggagattcagattattttctgaaactttaaataataaacactgattatgtatttatttgctgtgtgaaagttctggatagtgaaattaaaacttcccagtatggtatgatgtagactctttttagtatacctgacaaacaaaagaaagcaagccgtgctatctttataacacaattttccatgacgaggaaagaaaatggacaataaagaaaatacaaaccaccacttaataaagctgtcagaattgttcgatgggcctagaaactgactgtcattgagagctgttcagaatccatgtccatatctgtggtgcatatcaattgaggggtagaagcagcttttttaaagctctttttttaatataagcatgggaatcctgtgaaaggttaaaagctataatggatcaccttttcaacttgctaagtcatatttttattatctgaggtgatctgtattaatatatctgtataacagatgattacacagccttgaaaatagaaaatgttttcattccttagattaaatcaataaaggtgaaattagacccaactctcagaatacttagaatagtcatttatcacactattagcttggcatctcagaatttacctttattaattttggcttcactaattctaaattttgtgattatttagacaaaagttggactagaattacttttgtgagattctgtaactgtgtaagtagaaacaatcagtgactatttaaagctatgtacgagaccattctttggaagttcccatatacttggaaacattgataagctatttaaaaacaatccttcccagtcatcagtggaatcccagagatgctttttcttgcttcttttttgtactgtattctgggcttaattatggtgggaccaaggaatgggcgggaccaaggaatgggcttctgattcacaagcaggccgtaaagcagccaaggtatctttcccaaaatttgtttatggcctgattgatttgggatgtctcagaactcatacttccgtgggcaaaaaaatcgttgtaagtagtagtgaatacatttcagtacttacgatgaaatgaagcccattttattccatatgcagctgtgatagtctcatactagtatctccaaactgttatgttgttatatactctaccagtactaaaataccagagccatagtatgattaaaatggctttgggaacttgcgcgacatttttaacactacatgtgattgtgttttgtataaaagtgtttgtgttctaagagttcatttgtgagtaaatgactgcttgtagtaacgaaaagcgttgttcaaccctaaaaccatttctttctaggtcgtcaaatacagtttagatgactatggtttttagctattttaactaccagtagtatattaatagccttgcacttttagtcatttcacctacattagagattatgttggttttttgtactctgaactacaccatgagttgccctttataatattgtttattgggacaatgcattctacaaatgatggtggtttataaattttaagtctagggcacctgtgtgctctttcacttaaaatttataaaaatatttattataagaatgagagtacaatatacttagtaataaaaatcttcaaatttaaaacatgttctttgggtgattttcatagctgctttgtctttatatggtctttcaaagacatagttatgaatttcagttgttgcactgatgggggagaagaatttcagtaattactatattgaacgtggaaatgctgtataagaaccccatttgttgttcttaaaaatataaaagtgaactttctaagaggattccttctctctcagattaacaagtccacattcatagtctactgaatgtaaaaatgttcttgcttgaaatcttatatgattctatcctgaaagttaaacttaagaagcctagaaatcatgaagatactggttatatgtggcttactggatggctgcctaaaattatttacgacctttttattcttagatggccttatttgctttaactaatacgagactgcagtgagtgttattctggtgagtgggtgccattcctggctggatctaacagggagataccatccttgcagggagcacagtctttattccttgcagtgagacctgcttctccaggtgtgcccacaccttgttaactgtctttctctaactactgtggactctcttcagggaataagaattctttgtcctctccttggccgcccttcagaagcaaatgtctttcttctttgaatgcctttggtaggcatttcctgctctgttttcaagtcttgctcaacttgaaaaagtttttgaaccttgaaaagcaggtatcctgatctgctttcagtactaatgccagtgataaaattacactaattgcttttaatctcctagtcactttagttttggtatgagaacattctggtatttgtgaacaggcttttgtgccagaaaaataatataaaaccattgctcagaaaaatagtgccattaggagccctcagcagcacataataatggcaattaatgacaatcagcggccaactcactgctcactgtatctgatattttttaagggagcaaaacatatgaagtttattttattattatttttttactttgtgtaagtatttttacatctgcttgtgattattctgccttgtaactaccacctcaggcccagttctttttaggggaaaaaatgaattccttatgtaataagtgatcgtttggaaaatttctctgacagaccgtgagctcttcttatgaaacattcaataccaaaaaaaaaatatgcagctataattcactacagaagtatgggtttgtaagagagatagaggatcttatgtatccaacttaatttcttttgtaaggatgaaaatttgcgcctcatatattaatgtaataacttaatatgaagtgctgcaggtattaaaaaaaccctatcatctggataaactataagttgtgccaagacagcatggcatcgagtggaatcattttttttttgaaacagagtctcactctgttgcccaggttggagtatagtggcgcaatcttggctcactgcaacctctgcctctgggttcaagcaattctcctacctcagccttctgaacagctgagattacaggcgcccacaatcatgctcaggtaatttttgtagtttttagtagagacggggtttcaccatgttggccgggctagtctcgaacttctgacctcaggtgatcctcctgcctcggcctcccaaagtgctgggattacagacgtgaaccactgtgcccggccaagtggaaccattggaccttgttcaagatgactgccttattcgaaacaccttcagtttaggattatattgctgcatagactctaaaggaagaattatagccagattccagaatatgtacaaactttttatgtatttaaaaaaaaatcacaagtgtgtttaaaaatgtaaataaaggcagaaatatcaaggctatgtgtcagagacttgaaatagcatatttaacatcgatcataaaaggggcctcttgcagattgtgaagtggtggtttttaaaattagaagccgggtgtgtggcaagctcagaagcatatgacatagctgttgctagggtaagcgtgctgctttgggccaatagctgagtaaataaacaagataaacccacgtaaattgatggctctggtcctcctaactcattggccatctgcttattattttttttttaatcctgggttttctcaccctgcaatgtccatgtatctgacactttggaattcagatctgctctatgagattagtccgtcatctttgtgttctgctgtttgcttttagtgaaagtttgaaaaaccatgaaggccatggaatcaatgataagacagaacgtttcagaaagtcacgttctgaaacttgtctataagctgtgaatgttacttctcagatttttaaagtgttacttactttttggaagctggctctttatttttaatacaaagacagtctaagtcttttccctgcatgttatgtcctgttggtatgttcagatctgtctataagcatttttgtgttgggcacatataaaaattgggaggattgggctgggcgcagtggtttacacctgtaatcccagcactttgggaggccgaggtgggcggatcacctgaggtcgggagttcgagaccagcctgaccaacatggagaaacgccgtctctactaaaatgcaaaattagccaggcgtgttggcacatgcctgtaatcccagctactcgggaggctgaggcaggagaatcgcttgaatctgggaggcggaggttgcggtgagctgagatcgcaccatcacactccagcctgggcaacaagagcaaaactctgtctcaaaaaaaaaaaaaaaaaagggaggattggttgatttctttgggtgttgcattctaggtttccagaaggtgctgagcctgccttgacaagcactaaatggtgactgtgctagtaacacacgcagcatgcaagcttcctcctggagcactgtgctgggggttgtttccatagatattgtgggatagtaatgcctccctttactgtctcttgggtatgttgaaaccgggaagtgagacaatgcacatgaacatgctttgagttctttggaagaaagctacttaaatcaggcatataattagtttcatcaccattatgtgtgtgcttctcctgaaaattgcccagggaagctccacagtaaggcagggctgtagttgtacaaacacaaagctgccagggctgcacaccatggaaatggtggtttccccaggattgtaactccagtgctctgtcatgactctgaaacgacacctccaattggagagcgtggatgagcttcctccagacttgtggtctgctcagctgaggtccgggtacttgccttctgtttcatgagacctcatccttttccctacatgggctggatatctgagacagtgtggcctgtggctcccataagtaagtggcgagcggacaatcattctgctttcctaagagatgggcattctgactcagatgtggttgtaccaatatcttagcagatggcaagaaacagattgcagagacttggagaaaaaaaaatgtcacggatgtgtccaacccacttttggagctgtagccccatttgggatattttcttatcagtgacactgggagaaaggcttcatcccttggtaaaagtgacccttttgcatgccatttttctttggttgtgcagggggttttattattttcttcaaccctagcctccctgcagtcataactgaataagaaagtctctttgtatttgctcccttttagagaaggaggacagtccttaggtttacagaggttctctttaagcaactgcaatatttgattgactcctggaaagctcagagtctcaggaggactgaagattattaatgagcttttacctttgttgtgtattttaaaatgtacttattattctaagcaattatacagaactctttctaatagcatttttgttcttgatctgtagaacagggcacttatatatgcagagactatatatatatattggccgggcgcggtggctcacgcctgtaatcccaacactttgggaggccgaggcgggcggatcacgaggtcaggagatcgagaccatcctggctaacacggtgaaaccccgtctctagtaaaaatacaaaaaattagccgggcgagctggcaggcgcctgtagtcccagctacgcgggaggctgaggcaggagaatggcgtgaacccaggaggcggagcttgcagtgagccaagatcatgccactgcactccagcctgggcgatggcgagactccgcctcaaaaaaaaaaaaaaaaaaaaaaaaaaaaaatatatatatatatatatatatatatatatatatatatataaaacttagaattttgcagtgtgaattaagtttacatgttgtgggatagctttggtttctgtgatttctcaagaacagagtcacatacatctcaagagctcctgtccttccactgtctgcagacttagtggccctgggctgcctctttccctgaccaacatttgtctcaagtagtcaccaacaatgcccatattattacagggtgatggggactgtggagaaactgagttctaaatttctcttcttgtctttattctcttaaaataaggaaagtccttctttctctcccttccctccgcttcctcaaggctttcatggtaggtggtggtgaataccttggctggggttttagaagatggggcaggggaaggaggcaattgtggttttgttttctgttccttattgatagcacttccgcagaggccagtggcttttctagggagagtctgtgtttgccccaggcgaagcctcccattttatggaggagcctgtgatagtcgggactgtgttccctggagggctccctctcactgtgtgggagcccgaggcctggtggagcgggctttgcagcctcctcctttcatgcagcagtagctggtgtctcctttgcaaagccctctaagaaaattgagtggcagcctgtgttttgtcaaagaaggatggaagaggagggtatacttaaaacctgggtcttgagaggatgagctccgctcgttttagtctcacatgagtacttttatcattattgttgttgctattattggagacaggcaggagtcaagtgccatgatggtggcccactgcagccttgaccgcccaggctcaagcgatcctcccatctcagcttcccgagcagctgtgaccacagatacatgccaccacgctgggctaattttttaaaaatttatttgtaaagatggggtcttactatgttgctcaggtccatccagggaggagtgatcctcctgcctcagcctcccaaaatgctgggattacaggtgtgagccactgcacctggccacatgaatactttagatactgttgaccagaggccccatatcagctagaattgttgcaggtgcatgttgcctatgttcaccttgatccccatgagttctccaagaggtgcagatctcttgatgacccaagctctgcgtcttgcagacacctgaaccctgtgtctggcccacacagttctctgacagagactgtctacaatttgaacttcaaggggcgactcccaggcggtctgatgcattacccctgacttggccaggtcccaagctcttggcagcctcccagactgcaaaggctgtgcgtaatggctttccagagagtgtgcagcaggcccgggaggcctgggctcctttcctttgggggagatgccagctttggctcagcctcctggttggctctgaccaggaggtcagataagtggatgacgtaagtggatgacggataggcttcttggtattccttgtttatggtattaataaccagacatggaactgcaccagaaaggaggtttttaaaagtgaaagtagttagtcatgttgagccgggatggcaaggagaggttgccagcgccagtggtttgaaaggtgctgaggccccacctgtatggaggcagccgctcagggtgcctgctgagctgtcagtagttctcattgtcccgtaggggacccagcacctcccctcctctctgctgcccagccctgtggcctgagccaagtcgttcacggctgcgcctcccactttcttgtctgcagagcgagtggggttgccaggaaggtcatgtaaaccagtgaagtgggccaagcgggcattctattctgacgtttcttgaaacgtgcacaaagccctgtgagttccattgtgagtgcgaatggagaagcgttttctagactgagaacggttgacagtagttcctgcatcctggaacatggccgtgccgttcagtctttgtgttggggagggtcttggagaatgtgtggcccctctatagggccaccactcggcttcaggaaaaaaggcccatactatgagactgtgttttttgggtttttttaatgctataaatctgtaaaacttacccaatttcaaaaaatatgatgaggaccaaaactaaaaaaattatatgtgggcagaatttgctgagtcttccatctttgggataaaaacaatctcttttagctctaagttctgtgagtctctgattcttgctatcccctgaactaaagtcctgctactcaaagcgtatggtctggggaccagcacgtcagcatctcctttgagctcaagagaaatgaagaatctcgggtccgcacacagacctacaggatctgcattttaaccagatcccaaacatttccagaaagatgatgctaaaatgttttggagtaggggaaacatgaacaccagccagtatgttagcatgaatctggttttcaggttaattcactgaccaaaagaatcaatggatcagagcatatagagattacttttgaccaagggagaaaatagggtctgtaactttgttgcagagccgttttgcatgctctgtatgcgtgctctgcacagtggagtgggacgcatggaagctttgagtttctggttgaggataaagcgttattaactttattaagaattttaagcacctgcctcatgccgcacttccgctgctgctgctgctgctgctgtgtttttgagaaggaatctcgctctgtctcccaggctggagtacagtggggcgatcttggcttactgcaacctctacctcctgagctcaagtgattctcgtgcctcagcctcccaagtagctgggactacaggtgcctgccaccacacctgactaattttttttttctttttacttttagtagagacggggtctcaccctgttggccaggctggtcttgaactcttgaccccaagtaatctgccttcctcggcctcccaaagtgctgggattacaggtgtgagccacagtacctggcttatgccacactttcacataatttatcctattaagccctgacaacagtatcttgaggtaagaattatcacttgaagtttttagacctggaaactgagttgcagaaagcttgaggaaccatccaaggccacttgcttgctaggagaggaaagagctgtgatttgcacccaggagatctaagaagagcttgtccagtgcaagcttcatttatacaactctgccatggcctgcccttgctggagacatttttagattcagtgaacctgcctggtaaaggtgccatttgtagaattcccaggaataagaaaaactaaaatgcaggccttgtaatgctgctccaagtttattcattatgttttgttttttggtgttttttgaaacagctattacttaagctttcattggtggttttggccacggaaaagcagctacaaaataagaaatatttgtcacttcataaggaccaattattctgttttaacagtcgttttctgggtttaatccagcaagttgggtcctgattttgatttggaattagaattacagacaatagcaaattgagaacatacatgcaatcttggtgttgaaagaaaaccaaatgagtgtgaatctaaaaagcatgttcattgtgcacctttaatgaaaaaattttctgtataacgacctcttcaatttagtatttaacatttcaaaggactttgaaggactctgccttctcaaaagttgtcaaagattttagctattgtcatcattagacttcaaagcagaaactgcaggctattttaatgccaatgcttttaatcctaacctttgtattgagattaggagcacaaaggatggcccgtaaggggtgagctgagtttttctattttgttttctttttcttttccctaaagatttacagtgaaagctctgctctctagaattgttctttactcatggatagtttttttttttttttaggtctaaactattttgaaatctgcacaatggtgtctgttattaaaaaagaacagccacagtaatgaaaggacttggcacttacagatcaatttcatgtgcccacagcctgtttctgtaaaagatcaagagccataaatctctcccaaattatctgtgtttgttattattttagtgtttgaagattagacgtgtgtatggggtgaaggagttggtgagaattatgtgtagagaccccaggcagcctcaggccagcctcgcgaaggcatgtccccgggctcactgccaccctctctctcaccatctcatccttcttcacctccatgagccctacacacatcccttgtacgcctttctgctctcggcccatacatcaagcatggacatatttgtgcagtgtcctcacggagcaaaaacagaagcacacggtggctctatgctggcctcactctggaggaaaccacagagctccggcaatgaatagtttctcgggtgtttgtgcatcgcacgagttcacaatgcggctgggcgctgggatacagtgagtgactttctcttctcatgggccctaacatcaggtaggcttgtgtagccgtaagttaagtgagccgcatctccatgatctcttctgtccctggcaatgtcagatgcctcgcgttggtgtggcacctttcaccatttctccacggacaactccatctattaatttcttggagaaatctggagcccagatttagggggctcaagtggcatagttgatttgctgctgatgagtggaaggaagggttagtgggaacctgttgggtctatggccagctttggaggaggcttgggggatgggagcaggatgctaaatacagggaagaggggtggggtgtacttgagaagaacgtggggggatggcgcatggcaatgagaggcgatagtacgacatggtgcaaatcgtaccacgtcggaagtcagagacctagggcctagtccacttggtgctgctaactagctacagccttaggaaaggaatttggtgcctcagtttcttttcttttttctgtttttttagagacggaatctcgctctgttgcccagagttgcatgatcttggctcactgcaacctccgcttcccgggttcaagcgattctcccacctcagcttcccaagtagctgggactacaggcatgcaccaccatgcccagctaatttttgtatttttttaagtagagacggggtatcactgtatgttggccaggctggtctcgaactcctgacctcaggtgatccgcccgccttggcctcccaaagtgctgtgattacaggcatgagccaccgtaccctgctgagtttctttatccatatactgtgagtgcaggagcagatggatttaaaaatcttcagatttaaaagtcttctttttcagttattagacgatttgattctaaagtatccaggtataaaccaatcaaccaaccaaccaactgatcaaacaagccagaagtcttttcatggaggagaaaaactgtgaattttgcagaacgattgattgaaagctactgttagaattttaagaagagaatgtcacagccagatcagagataaagataattttttcatctacattcaacatgtccagaaaaagtatgtttggagactaggagaacagaaaagatggcactaaaatgtttaggttagaattaacttggggccttcgtctgataaaatgagagatgaagagaaaaagatggagccagcaaagtttgtgaaagagacagcagaaagccttgacaatgtctctgttagatgttttcctctcattttacaatttgaacaaccaacatgaaattttagcattttaccttggacagataaagaacattgtggggtaatatttttgcctgtttgataacttacttctgaacaggattttttttttcacctgtgtacagactctaaggaggaaattttttcaagaaatacacgtgattgttggagagttaaaatttagaccattgtgtgaagctgttaacgtctgtctcattggctgtgggaagaagagtgaaaacattctctaaatataatcaacagagctgtagggtggtacaggtctcttcaagagcctttctgccttcaatgagactgaagtaaattgccttttctgaattccccaagggctgctgaagttactcgcaagctcagagattgtctaggaaagaggtgcagccacaccatcaagaggtgaggaaatcttagtcccagtcgtggagaacaataaaaggctggctgagtgcagtggctcacacctataattccagcactttgggaggctgaggtgggcggatcccgaggtcaggagttcgagaccatcctggccaacatggtgaaaccccgtcactactaaaaatacaaaaaaaattagttaggtgtggtggtgcgcctgtagccccagctactctggaggctgaggcaggagaatcacttgaacctgggaggcggaggttgcagtgagctgagattgcaccactgcacttcagcctggcgacaatgcaaaactccttctgaaaaaaagaaaaggcttggtcagtgaatggaaaggacatcactgcctcacattttaagctcttatatatttgttaaataactaaatggaatttcttctgagaactagaattcaacatgaattattacacagcggggcatagaaaaacctgataaaaatattgaaatctctgtttaagatgatatttaggcagaaatacatggaaagagtaatttttctatgtttaattgtattgctctcatcctcactcaagccaatttcgtagcacgaaatagacttttcatctgatttcattctctgtgtggcatgcgtgccatcatctgcgtagctttggaaagctgacggatagtgaacagaattatcatagatcgagacatctttgggtattctccattctagaagtggaacttaatttgaaccaacaactttaaaagtaacgtatttcgactggtttgaacttgagctgacctagaactgaattaattacatgtaatgaggaccccagccaaggcaccactcggacatatgcgctgtggccagcagggctatgtgagaagtatgagtaagtgacagatactaggacttcaggtctactgtacactgatacccagctcactgttctggaaaatcacagtgaaaatgtttgtccgaaaacagattccagcctgttctctttttacaatgactcccaaaatggaatttgggaaactgaatccctgagataaaatgccattcccttgatcccagttagacccttccctgtttttctgtgtgtggaattttctgttaattggccctttactctgaatacacattgatctttatgggttcctgagtgctaggttcccactttttaaagcaattataaaagaaaaaacagggcatttcccagacgtaaaactccttctcatttcccagtgggtcggttaatcccgggatattgcaagagttcagtgaaacctaattcaattaacttctatcacttcattctatcccaattttgagtatacctttagctgcattaagtggaacaaagccaagcttttggtcaatgtcagattaatatctttctcccaacatttagattgaatgcttagtttttgtagttgaccaaatgcactgtagagttgtagcagctgttaggatttactatgcctgggttacacttttgctgcttccttttaagcgggcttcatatttcattgaatcttatagctggaagagaccttagaatccttctggtctgatgcactggttttatataaatgaagtaatgaagcccacagaggctaagagacaggcttaaggtcacaaagctagacagtggcaaagccggggctagaactgcaatttcccacctcttgcaccagtgtttttggtagcttacttctgaacaggatttaatgatattctttacctctgtccagattctcagtggaaacatttccaagaaatgctaaatgttattgttggagatttaaaatttagaccattttatataactgttgctttttttttctttttatcacgtacaatttctaaaatacacaaaagtagagagaatagaaaaacaaacccaatatccggcttcagcaatgtcatcatgtttcatttatatccccatctactccctcctccccccaattattttgaagcaaatctagacatcatattaattcatccataaatatttcagcatgtagctctaaaagataaagacccttgaaaaatagctacaatactattactaacctaagcaaattagaagtaattccataatgttattaaataccccatagttgttctgtttgacatgttataaatttttttttttttttgagacagagtctcgctctgtcgcccaggctggagtgcagtggcgcgatctcggctcactgcaagctccgcctcccaggttcatgccattctcctgccacggcctcccgagtagctgggactacaggcacctgccaccacgcccagctaattttttgttttttagtagggatggtttcaccgtgttagccaggatggtctcgatctcctgaccttgtgatccacccgtctcggcctcccaaagtgctgggattacaggtgtgagccaccgcgcctggccgacctgttataaatattatatagtcattttattttcaaatgtgttttccctttcgaagaggaaacaaactgttaagaatgatgggtgttttaggtgaatggaatgaggagaggtgctgtaaaggtcttcttcagtatcactgatgaaatgtgacacgactttacaattaatgaagaatttgctagatagtcgcttaattttggagtgttttctcttttccaccaaaactagtaaattttattttatttttttttgagatcgagtcttgctccatcgcccaggctagagtgcagtggtgcgatctcatctcactgcaacctccgcctcctgggttcaagtgattctccctccctcagcatcctgagtagctgggactacaggcgcccgccaccacgcccggctaattttttgtatttttagtagagatgtggtttcaccatgttggccaggctggttttgaacttctgaccttaggtgatccgcccccctcggcctcccaaagtgctgggattacaggcgcgagccactgcgcctggcccaaaactagtaaattttaacatgatgcttttctaaggcactgcagctgttctttttatatcccttgaagtcatttgagtatcagtatattaaaaaacttgtcaccacagaaaaggagaaagactgggtcatctttgttggttgtctctaatttttttttttttttagtgtgagcagatgtgaataccttgagctcctagggtccggtttagtagcatgagatagaaaatattttattggtttgggaggctgaggcggatggatcgcttgagctcaggagttcgtgaccagcttgggcaacatggtgagaccctgtctctgttttaaaaggaagaacaaataaaataatttatggttagatacatgtcctattcactacaaactatattccagggaaggattttagaggagacaggtttatccttttgtgggatccttttgtgaaggcgtttctcatttctttgacttctgcttttacgtttctttagtgacagaagccgcgagcaggtgttgaatgaatatcccatcccattcatacgtttaggctggcgtgacattttgtgctgcagaatatagggtacaaaaccgaaatgtcctcatcacttgtctgttgtgatgagaaagctacaagtttgtcaagttggctgaaaccagattgtctgccttagagaaacgttagggagagtgggatcccgggagtgagaatccagaagcaggattttcctgagagcagcggtcatgaaagtaaaccttggtgaatgagccaactgggagaaaagaagaaaacaaaccagccaagtacagctgtgtgcctgggcgtcgcgtccccgtcgccacacatcccagacctaacagcgcagagacatgtgagctgaaactagtttaaggcttgctgtatctaggtcagactgacttccagggcataataaaaacccgtgtcttctggtaattggggccacagacgcaccttgtgacttgcttaaaatgtttcctcctactcccccatcagagtatagtcgcccaccgccccccacccacctttcagaatttggagaagctcctttttttcttcacctttcatactgtttgttgttggtgtgtatttgttttaccctttctttgccattggctttggctggtccaagaaggacaagtgtttcagaaaaaatatagagagagcaacagagagacagaggacttatgtagctgatcagtccgagagcgggaacagctgttttgtagggctgaacactcagatgtccaaaggcctgcatttcgtggtcactgcctcctgcctgtggcctccttgctgtatttgagtgatgatgattctggttctgtgcagcgagacaaatgaggcccctccatctgtggaggctgtgcagggtgccggctgcctcgcatttgctttgttaatggtgctgaggaagaaagaggaaatgcctcagcttctggaagctaaacaaagtggatgtctagcctgatggatgagtggagtttctgtatctcccttcaccgatagtccattcatccaaggtcctgctccttatatacactggtgtttaatgctcttactgtgggctttgcaggacctcctctttaaattttgtttttaaaagttcattgatgataattgaccaatagccaaattcccaaaacccgtgaaggaccttagtcccctttataacaatgtttgcgtggaaaaataagagttccagtgtcaacacgcatctcattgccccattacctgaaactgttggccgagggagggaaccctttcctggccccagcttatgagtctgcagagatggaggcccacataacagggtggacacgagggctctgagaagggtcctccagagggcgaaggttcagatggttgctggatggtgtaggcagatgcaagatcaggagggtgaaggttccgatggttgctggatggtgtaggcagatgcaaaatcaggagggtgaaggttcagatggttgttggatggtataggcagatgcaagatcaggagggtgaaggttccgatggttgctggatggtgtaggcagatgcaagatcaggaaggtgaaggttcagatggttgctggatggtgtaggcagatgcaagatcaggagggtgaaggttcagatggttgctggatggtgtaggcagatgcaagatcagggtcactaggattgcacaacagaaaggggggggaatgaggaaaggcctccttggagacaggccttgtacctaagagatgatttgacaatcgaatgtttctaagcaggggactacctggatttttcagtaatacagactgagaagaaattctgcctgcatgtctgtgagtccattgaggacacttagggacacaagagaaaggggaaaaaagctagtgtttgagcaataaccatgtgtctgcagctcctggcactctgttccagcaccgtccaggtgcagaatgaaaggcagccagactggaattaagcaagtagtcctggagtaagatgcaagtagtagtggggtaagtagtgtggtaagaaaaagaccaggtctttttcttctaagcatctttctctgcaataccacttttctttttgaacagccattccccaagcacagacgtctcattagttgaacacagagcaagcagtccttaaaaacaaccccactctgccatcttttttctcatcctccctcccacagatgtgcattcaataccttctacacacgaagaataatgccagattcttgaaggctatgttcctatccatcttgagattctttttcatggtggatcaactcagtgctactgcataaagttatgtacttctggctgggcacggtggctcatgcctgtaatcccagaactttgggaggctgaagcaggaggtttacctgaggtcaggagttcaagaccaacctggccaaaatggtgaaaccctgtctctcctaaaaatgcaaaaaaaaaattagtctggcgtagtggtgcatgcctgtagtcccagctactcgggaggctgaggcaggagaatcgcttgaacccgggagatggaggttgcagtgagccaagactgtgccattgcactccagcctgggcaacaagaatgagactccgcctgaaagaaaaaaaaaaagttatgtacttcttccctgtacagggacgtcatagctaagaggacaaccatttgtcagagacaccatcaatttaggccgttataaatttagtgatttagtatttggagagattatagtatttggagagatggattaatgtttccttagaaaggaaactctttattccctctaactgtccaaaaggtactgtgtgagctactggaggcctttcccctttaggatcagacatatccctactaatgaaggacacttacacatcattagcagactccctgctgagcgccctgcatgcacgctcttatttactcttcacacaacattaggagagagctctgtttcccattttgccttggagggaataaagccttagcagagattttggacttcgctcaaggttatacctctaataagtgcaagatccaggacttacatccatgctccaaagctgatgctgttaaaaaatttattattttgttttattttgagacagtcttgctttgttgcccaggttggagtgcagtggtgcaatcatacctcactgtagccttgagctcgtaggctcaagctatccttatgcttcagcctcctgagtagctgggactataagtgtataccaccatgcccggctaattttgtttgtttgtttgtttttggtagagacagggtatcaactttattgcctaggttggtctcgagctcttagcttcaagtgatcctcctgccttggcctcccaaagtgttgggattacaggtgtgagccactgcgcctggccctggtgctcttttttaatactgtagaatgctaggcaaatatcttagggccatgtgtatctttctaccctaccgggaggaaaatatggtgttggagaccttcaattgtctttcattcccctgagacagcttcatgtttcaatggatgaagattcaaagctctgagcaagaacccctccttagacccttcccctaagcattactaatagtagctaacatttataatgctctctaccaggcattgttctaagcagttcacatggattcacttattcaagcttcacagcagccttgagaattctattattttccccgttttacagccggggaaactgaggcccagggatgctcacacagctagtcagtggctagcgcactttacctaggcaggctggctctgcattctgtactctgtacctctctggcatgccacttgggtcccaggtaccatgagcccatgtcctgtttcctcccgaccttgaaggagctggaggaggaggcctttgcaagtgagggctcgaggctggtactgaggcagcaccgcctaattgggacctggattaattctcttgcctgctccttgccaatcccgtggttacttcttattctgacttgcttatttctgggccctggggcttggcaaagcagaagccagaggtttgcagagtctgcacaggaatgagacagactcttgctcctgttaatgagcattaaacatctcaagtgctaccttttccccacgcctttcctccacttcattcttttggatggtgctcaaacccgcaattatgctgacttactgcttgttcctggggctgatttggctctgtgctggggaagggggcaaatgctgcctttctttggagcacagaaaacaagttggcttcttcctctgtcaggaaaacacagttacccaaaagggaaggtttgctttgatgaactgccaaagatgttctcgatgcgttattggaccgtcttttgcttggtttattttttttccttaatgaatttggctttggtttatcagtccaagggagttaaaggatcgtcctcaacgacactgatcggggttgaactgcatccctcacagattcatatgttgaagtcctaaccacctatagctccaaataggaccttatttggaaatagggtagttggcgatatcattagttaagaggaggttgtactggagtagggtgggccctcatccagcatgactggtgtccttataaaaaggggaaactgggacacaggcacacagggagaatgcacagacagggacggtaatgcaggaaccaaggaatgccagaggtcaccagcgtgccccagaggccaggggcagggcatggggcaggctcttcctgcagcacccccagaggaaacagccctgctcttaaccttgatcacagacttctggtccccagaactgtgagacagtttccgctgtgtaagctgccagtgtgtggtgtttcgttacagcagcccttgcaaacctgtacaatcaccttcaacaaacagacagtcaaaacaaaagcatgaagttagcaaagtttgatggacctgagcctccgtgaaggaggccttcccttcttctgcagcaacttcgagtcagagggcccagccctgaaagggcctggccggggacttgaatggggtctgctggggcacggcaggcctgagtctgaggccaggcataccaggccacctcccctctttctacacctgcctcctttccatatatatgtggagagagagagagaatattcaaggatggctggaaacctttgttttctctgtggtaatactttctgttttttcttcttttgatgaaaagatggatttcataattgattgttaagggattactgctgtttagaggccatacaagaaaaagcgagctacttgcttctatttcccacaatatggcagactatacagcctgagaagcttctaggtttgaaaaaaattaatttccagctgaaatattacatagtatttcttggctcttcagtctcatttaaaatacaggtctagctccatacacctgcgcataccattaagctagcaactcagacccgagggaactggccagctcatactgaacaaggaaaccggtaaactcaggtaaactcaacaaggtttgactatttaaaacagcaacagggccgggcgcctgtaatcccagccctttgaaaggccgaggtgggcagatcacggggtcaggagatcgggaccatcctggccaacatggtgaaatcccgtctctactaaaaatacaaaaattagctgggtgtggcagcttgcacctgtagtcccagctaccctggaggccgaggcgggagaattgcttgaacccgggaggtggaggctgcagtgagccaaggttgcgtcactgcactccagcctgggcaacagagtgagactccgtctcaaaaaaaaaaaaaaaaacagcaacagaagaaagagggacaggaaaaggagggaaggaaggagagagggaggaatggagggaggaaggaaagaagggagggagggatgatggagggcagaaaggaggcaagcaaataaaatactgagcaactcaaacctgtgagccaatgtctgtgcacagagttgaatcagtctaaggtctttgtatttgggagaatggtggagatagtgatcaattttagattttacaaaagttaagaatgctcggaagggtaatcattgaaagagtaggaagagaagcagagatggaattagagaaaaagagagagcttgttattcaataaggctggttgcggtggctcatgcctgtaatcccagcattttgggaggctgaggcgggaggatcgctgaaggccaggagtttgagatcagcctgggtaacacagggagaccccatctctacaaaaaaattttaaaaaataggtgggcatggtggtgcacacctgtagtcctagctacttgggagcctgaggtgggaagattgcttgagcccaggtagtcaaggctgcagtgagccatgagcccaccactgcaccccagcctgggcaacagagcaagaccctgtctctgacaataaaaaataataatccaatgtggcacaactttttgagctgtctaggggttaaccacctgtcagaatttgtctgtgtgctcacagtttgcaattgcaaaaatatggaaccagcccaaatgcccattaattaatgagtggataaagaaactggtgtgtgtgtgtatgtgtgtatatgatggaatatatatatatatctatgatggaatatatatatctatgatggaatatatatatgatggaatttatatatatatatatatatatatatatatatatatatatatatatatatgatggaatactactcatccataaaaaggaatgaattaatggcatttgcagcaacctggttaagattggagactattattctaagtgaagtaactcaggaatggaaaaccaaatgttgtatgttcttgcttataaataggagctaagccaggaggatgtaaaggtataagaatgatacactggactttggggacttgggaggaaagggtgggagggggtgagggataaaaggccaaaaattggggtcagtgtatactgctcaggtgacagatgcaccaaaatctcacaaatcaccactaaaaaacttacttatgtcgccacacaccacctgttcctgaaaaccctatggaagaacagaagtattcatcatttttaaaaaaatcaataaataaaatgaaaatttaaaaaaaaggaatttgtctgtgtgctcagccctgaaccaggtatagtgtattagtttagaaatagctaatatttactgagcattaatgaatcgccaggcactagtctcaggtctttgaagagatggttgcttttgttttccccatgttccggaggaagaactgagaagagcgtcaataggacaggccggcggtctccacaatgggagtagaggtgctgggattcacacactgtccgggatattccagagcgttcatgtttaacccctgagctatactgttttagtaaaacccttgttttgtcttagcaaatccttgtcttagcaaaattctgaaaaggtggtcaagagaactgtgtccctccgagatggctccgggccgccctcccctcgtctcctatgctgcgcctgtgagccacctcgggaaaccctgaggctgcacacaacaccgtatggagccttgccctgcttccataggtgtaatttttttgagacggagtctcgctctgtcgcccaggctggagtgcagtggcgcgatctcggctcactgcaagctccgcctcccgggttcacgccattctcctgcctcagcctcccgagtagctgggactatgggcgcccgccaccacgcccggctaattttttttgtatttttagtagagacggggtttcaccgtattagccaggatggtctcgatctcctgaccttgtcatccgcccgcctcggcttcccaaagtgctgggattacaggcgtgagccaccgcgcccggcccattcacactcttcttgcatgcacgctgacaagggcatcaaagcactttctgttgaactgcgtatcgtagttgccgaggttgtggcggtgtgggacaacagtctgcagtgacatggaaaagcaaactggacactcttctcataatcgatacatacttaagatatacttaacctctcctccgaggcagttttttttcacttgttccagagtctgagtttaggatatcacacgagcaactgttacctaccaattagtaggtaacagttagcatgtaggttgtgactccatgaagaccttgctttgtccaaccaaacatggatggattcccttacacctaaaacttaagtaatttagctttaaaaatgtatcatggctctggaaaagtctgtaggaggcttgtctccagggacatggtgatgtgtaagcacagagtatctagggccagaaagccacatcagatatccttcggaaaccagtctctgagattttggaacaaaatgtgtcccaccgtatctctgggtccaactttctttttttttttttcccctctccctcactgtctttaatttattgccttctggttctttctcacggtttctaattctgctcaggccttatcccatttctaggatattttccgctcgtatctactgagacgccacagccccaggtaagcggcagttccctggcggtacagaagtgatcacgtggaaaccctgcagtaggctgggaccagtgtggactgttagccgacctaacagcctcgtctatggtctgaaacatgctccacatgaagtgctggcacttgccccttccctttgcggccagcatcttagcttggtggactggacgaagccggtggtctcttcagagacctgtgggaggaaaagtctgggtgatgcaagtgatgctggacttcatgtttttgttactggaaacatttgcaacagatcttgagtcttcacccttctagtcggggtgagagaagagcggatggagatactcttattttacactattattttacatataaaatacactattattttacatataaaagtgtatatttcacatataaaatacactattattttacatataaaactgtctgatcctgcaggtgatttttcctgtctccccacttagatttatttgttcctcttataaagcaaaactgtaacttaaaaaaaaacaaaaaactagcctcctttccctgaaaagtagagtgaccttgtgtccccatttgtccaggagggtactagtctaagcattttgttctagtgtaattagtagcatccttcttactttaaaaaacatcctagttggctctgggaggccaagtcaggtggatcccttgagcccaggaatttgagaccagctcgggcaacatggtgaaaccccacctctgctaaaaatacaaaaattagccaggcacgctggcgtgcacctgtattcccagctacttaggaggctgaggcacgaggatcacttgagcccagaggtcaatgctgcagtgagcggtgatcatgccactgcactgcagcctgggcaacacagtgagattctgtctccaaaaaataaaaaaaattaaaaatattaaaaatatcctaattgaataataactgacatggtaactctaatggaagctactgcgaactacagttatattatagctaatcctctgtgcttgaaacagcacctttaacatatggtatgaaaaataatagaaagatttaagattattacccataagcctagctacttaaactgctaaatattgaaacaaaattttaaaaaatgtttcagatgaactcagcagaaattattaaataatagcatctctgtatttttattctatattagcattagaaatgttattagtaattattaaatgatatcacataaaagtcctgtaatttgctggagttaaaaagttattcttaatagtgtctgggatttaaatatatgggacctttttttttttaacagttattgaaatttgataaagcaggaaactatttgagctttgcttccctttttgatatatgattttaattgttcctgtataacattcccttaaattacaggaagccacatgttggaaaaaggatccatcctttaaactccatctgtgttatagtgtggtttttcattggcttgggaagcagctctgtggtgacctgcaaacagaattgagaaaagaaaactttcaagactgattagtgtgaaggaggtttgtggatttaactctctcggtctcttgcaccatctgtataaacgagctgcggggaagtcatttgagtcatctgaatacatttgtactctattttgcattcgtgtatattcataaaaactaataagacatcctaaaaattgggggctattctagcaatgcaaagatttatatggactttgtttggatgacacaaacaacaataagaaaacactaaatccagtaactgctcgcaccaggcattacggaggcaatggagtgaggcaggagagtacaatcgcggactaggatgtcaagaatggaatgctggttcctcaagctctgtgggcaaatcgtggactgtctctgagccttagtttttcatcctttcttatgatagcaacccctgccttgcctgccttatgcataaggctcaataaattgtcaagtcctatatgaacataaggcattatttgtttttccttagatagaattcttatctataaatggatatgagggacatgaagtagatacaatatttgttcctttatgatctgaagtccacggccatttgatgcccctctgctgggaaccatagcactgaagagggcctaaaatgagcacattgtggcacactttattgagggcctattttttgaaaggcactaggcataaaatgattataaagtgaaatctcccctggccaccccattttacattgctaacgctcagtctcaatcttcgtcttctgccttattttcttccattcatcactattttatattcgacacagttcactaattgatatgtgtactgttgtctcctgcccttaggaggcagattccttaatgacagaagattttgtttttgttgctattttattgttttatttttgaattttggtaccccagtacctagaaccattattagcacatagcaagtgctcaataaacatttgttggatgaacaaagcagccattactcttcagtcgtacaccgccagggaagcagacagacatttttgtagggtgttgtgttgcattattaatacaatgaggtcagcagggtaataggaagggcactgttgttatataaacaggacaagggcctctaaatctgcagggatatttgagggcaaagataaggagaagatggaaagtctttcagagaactgacctgggtttgaatcctgcaagcaggatacatgagagtttccagaaggccaaggaggtgctagccagcttacagcaacagggcggctcctaaggcctgcaatgagaaatgaccttgctgaccactgggcatattttggtgtgtggtgcacattgtgacaagggcccttgatgattcaatgagtcagcaggagaaaatgcgagaacttgggtatttatagtgatcttttaggtagaaagtaccaaataaatgaagtcttaacagctgataccaggaccagcgctgggtgaaatgtgtctggtggcagtgagttacagaaggatgtgtgggagtatcatcaggcgcaggccattctccgtggctccgtgtcgtcttttccttgtttatctttttatagaaacaagatcttactctgttgctgagattggagcatagtggcacaatcatagctcactgcagcctccatctcccagactcaagcagtgctcctgcgcagactcccaagtagctgagactacaggtgcaccccaccatacccggataattttttaatttttcatagagacgggatcttgttatgttgcccaggctgttctcaaacttctgggctcaagtgatcctcccaccttggcctcctaaagtgctgggattacaggcatgagccatcacccagtcccgtcttttccttttagtatatttcttcctactgcagtttacctgtgctcattaagtggatttacagctcatctgatcttcacgattttgtaacgagtttgggagtaaccttgaaaagtttttctacttcacaaaaaatccactgattaattgtgacaaaatactttaaggaggtgttcaacataaagataaggtatgcattttactttataaatgtccagagttatatttttgctgaccttttttgaatacagcgatgttagtactagtcactataatccaaggaacccaccaatattgtcatttgggggttagttaaatatgagctgcatgaagcagttcacaaagacattgtggtgagtcttgggtggtccagtagagaacttgctctgcctgttgaagcttggcagtggaagcaagcgttacccactgcggtttccctggggcaagcctgagatgcacagggaaaatctaaagactcacttcatgaactgttaacattgtcagtcatgtcaatcaggcaactaaattcctactcttttcctcaacctgtagaggtttggtgactcaaatcaactattgtttcattccgaagcttcttggttttcatgggagaaagcccgttatttgtctatttgggtttcagagaaacattaggtctttctagaggaagcctgttctctgtgagagcatgcctgggtgcttctggctttgtagatgactgtattttggtgctagctttgcttacttgaagtcttgtgggtataaccttaggttcttcagatgagcagatgtagctgttgtacatgctaattgtcaaagacagggtttcagtatgagatagctttaaaaaggggactgcaaatcggggctgaggagctggacactgaggtcatggtgagctagtttcttttagtgaaatgagcaactttattctgaactctttggattttgctgaaaatattttagccattttgaggagaggcttgagagcttgataaaagagcctcatagatattttcccaaagaagatggcagtaatacacttcagatgcattagtaaatacacagcatatgcagaataaaaacagatcctgaggttcatttcaagtaatacggtttattgaacagaagtcagctggctcattgtcagtgtccagccttatcagaaaagatctttaaatatttttcatgatttccaactgcattcacattggggcttctccacgctggttaacataaaaagtgaaacatacaatcatattattatgcagtctgatttttgccttaaactatttaatattgaaacaaattgctgattatcacgttcctttttttaattgaaaagcttattttgaagtaagcattttaacaaatatattaggcataggattacatatattttatcatctatcttattttaatttttaatatttaaatttgtagcatagtcttatttcattggattttttaatgtcacattttctgtatctttggcaggtgacaccgattttctgcttccgccctccctctccttctccagtgccttgactcgggccttcaggagataggaaggctgtagaaacacagtatggcggtggactgtgtgtagcgatgtgtgtgtgggctgaagcagggagagcagtgagaggaggtgattgagaatgactcccaggttcttgccctgggagactggacagtgggactcccatttgccatgactggaaatgtacgctaagaccccagaggttgggagactgggcataaagatgatacattttgtggaatgagcagcttgagtttgattgtccatggagcattcagaaaagatattcagttgacagtaggaagtaagaatttggagatccaggagagaggcctgggttggtgagagttatttggaaatcattcacttgcaagcgctgaaataaagcagtgaatgttgtggaaggaactgagctgatgaaattctgaatgccaagaagggcgattgggtggaatccagagaacacccagtactgaatgggcagaggtaccatggataaggaggagagcctgtagagagtgacaatgaaaatgacagggagggaagagttttaaggggagagagtgggcaacagtggcaagcatgaaaccaaataaggatgaaaccaaattcaacgtcctgagtggatttggcagtggcgagatcgttagctacattagcaagaagaaaaatgtgtttatgggtacaccttgtttcactgctctttgctttgttccactttgcagatattgcattttttacaaaccgaagttttctgtcaacgctgtggtgagtaagtctatgggcgccatttttccaacagcatgtcctcacgttacgtctctgtgtcacattgtggcagttctctcaatatttcaaacttgttcatttttgttatatgtgttatggtcatctgtaatcattgatctttgatgttattattgtaattgttttggggctccacgaagtgtgcccatataagatggcaaacttgatccgtaagtgttgtgtgcgatctgactgttccaatgactggccattcccctctctctctccctctgctctggctcaacagtattgaaactaggccaattaataaccctgcaatggcctctgcatgttcaagtgaaagaagagtcacatgtctcttacttgaaatcaaaagctggaaatgattaggctttgcgaggaaggcatgtccaaagctgagatgggctaaaagataggtctcttgtgccaaagtcagccaagttatgaatgccacgaaaagttgttgaaggaaattagaagtgctaccccaatgaacacacgaatgataagaaagcaaaacagacttaatgctggtatggagaaaatttgagtggtctggacagaagaccaagccagttacaacatttcctggattagccaaagcctaatccagagcaaggccctaactagcttcaattctctgaaggctgagaaaaatgaagaagctgcgaaggaaagtttgaagctagcagaggttggttcatgaggcttaggaaaaggagctgtctccataacataaaagtgcaaggtgaagaaggaagtgctgatggagaaactgcagtaagttatctcaaagatctagctcagatcattgatgaaggtgactatactaaacaatgtattttcaatgtagacagaacagtcttattttggaaagagatgccatctaggactttcataggtagagaggagatgtcaatgtctgccttcaatggtaccaccttcaaaggacaggctaactctcttactaggggctaatggagctggtgactttaagttgaagccgatgctcatttactataccaaaaaacttaagacctttaagaataatgctaaatctactctgcttatgctctataaatggaacaacaaagcctggatgacatcacatctggttacaacatggtttactgaatattttaagcccactgttgagacctgctgctcagaaaaaaagatttctttcaaagtattattgcttattgacaatatacttcagtgacagtgatcactgaagagctctgatggggatgtacagggagattaatgctgttttcatgcctgataacacaacgtccttttgcagtagcccatggattaaggagtaattttgattttcaagtctcattatttaagaaatacgtttcatgaggctgtagctgccatagatcatgattcctctgatggatctgagcagaataaattggaaactttctggaaaggattcaccattctagatgccattaggaaaatttgtgatccatgggaggaggtcagaatatcaacattaacaggagtttggaagaagtttattccaacccacaggaaagattgtgttcagatgcttaggtctttaatgaatgttccgtatactagagatacaagttcaaaaattcaaactgcaagttttcctttactagagatgcaaattgaaaaatcaaaatttccttaaggttttacattcaatttattctatttgtaaattttgtatttttaagtaaaaaataaaaaccataactcttggggtctttgaaaatcatttgatcaacttgaatggaagactaaatcccttttacttaacaattagccctacttagaaacatctttaaatacattcccttaaacatttaaagtgcatctataaatttcatttatttaatttttaaaatttattactatttttattgaggtaaaatacacataacgtaaaatttaccatcttaatcatttttaagtgtatatagtccagttaagttaaatacatatataacattatgcatccattacgaccatctatctccgtaattcttttccttttgtaaaatggaaactctctaccaattaaacaacaactcaaacaacaacccctcctttcacctttcctccagcccctggccaccaccattctcctttgtgtcattatgattttgactattctaagtactttgtataagtggaattatgcattatttttctttctgtgactgacttctttcacttagcattctgttttcaaggttcatccctgttgtagcattggacaagatttcctctctttagaatgctgaatagattccattatatgtatatattgcattttgcttatccactcatccctcaatgggtacttgggttgcgcccatgttttaactattgtgaataatgttgctatgaacatgggggtggtccagatatctcttcgagtccctgctttcacttcttttcgggtatatctagaagtggaattgctggatcatatggtaactctatttttaagtttttgaggagttgccatactgttttccacagtagctgtaccattttgcttgcctaccaacagtgcacaaaggttccagtttctccacataattgccaatgtttgttattttctggtttttgggtattttttttttttttttgatagtagccgtcctaatgggtgtgagttggtatctcattgtagttttgatttgcatttctctaatgattactgatactgagtatcttttcatgtgcttactggccatttggatatgttcttcgcagaaatctctattcaagtcctttgtccatttttgaatctagttgtttgtttttttgttgttgagatttaggagttctctgcatactctggatatcaatcccttatcagatatatgctttataaatattttctcccattctgtggattgtcttttctctgttgacagtgtcttctgatgcacacattttaaaaatttcatgaagtcagtttttctgttttttcttttgtggcttgtgtctttgatgtcatatacttggtacacttgatttttaaaaagtagttaatatatctgacgaggaaggcttcaacccaaattttccccagtactctattgggcctttagtagtcatcaaatatgtgccaaccattgctagccattggggatatagctctgaacaaaacagaacaatgagcaacaatgaataagacagaaaatatccctcatccttatggagtttacattcttctaactctaaattcattcaactgtagcaaagctgataaactaaagttttaaatgaagaggatttcaagtcaaaatttgtatacctttcaatttaagattacaagtctaaaatcaattatacatttgaattagagtcacaaagcaaatctgtgtaattagtgtctctaatctgtctgatatgaaaataccaaatatacacattttaaaagcccgattaaataatactaatgctataaaatcgatttgctttatcattcatttaattctaactttcctaatattgaatactggcttacaaaaccgagcttgcttgatggacaactcatgacccaggtacatgattgtctgaggtaggtttagagatctgaaactgggcccagggacataggggttgtatatgaccagagtgactctttccatcataacacagatggacagactgagtctgattttaatagtggctatagtaacagggaactccatttttcttcagattggactggtttcacaatacgctgtttgctagatttaagccttcccttcatagcactattcagcattgtccccagtttggatggataaattactacaccacccatacctactttgccatctgatccgattcagctaactcagcctatgtaccacctgattattctacatcaggctagttggccacgaacactggatcatgtcacccctctgcaaggtctgcatttggaggtggctgagtggagctatagctcttctccccaaatgtccatcaactcacctcccgtctttcatatgaacaattaatattttctcagtttaatcaagtgcgattcaaacttacttccagaaaattcttagtcaatctctcccttcgaacagattccctcttcttctgtaaagaaattctaaaaatatcattgcttctttgatccaaactcttcaacggctcacactgcacttggaatagaatataaaacctttaccatggcctgcaagttccggcatgatctggctctgcatccttccatgacctcatcacaaacctccctcttactgtgctccaatttcagccacagtggcctttttccacttcctccaacagaaagtcaagatcccttctaccccagggcctttgcacagactgttccccctttctgtaacaccatctcccccactctttgcttgagtggctcctcatgctgtaggtctcagctcaactgtcatttcttagagagattattgttcttcatagaacttagcacaatttctgcatttatttgcctactgtttctcttccatactagacggtttgctgcagggtcatgtgtggtgttctgtttgcccagcacccatcccagggcttgcgtattctagacagtcagccattgtttgctgaatgaatgactatcacagttgccacagcagtcaccattagctttaagtcatagctattataatcattcatataaccacctttggctcttgggaggtactgagtaattgttgaattgagatatctaaatgtcagttctcctacattcattaatacaacttgttattaccttatggtcctttacaccagcggcccccaacctttttcacactggggaccagtttcgtggaagacagttgttccttggactggggtgggggtagggttggagagcagaaggttttgggatgatttgagtgcattacatttactgtgcactttatttcttttattattacattgtaatatataatgaaataaatatacactcaccataatgtggaatcagtgggagccctgagcttgttttcctgcaactagagagtcccatctggaggtgatgggagacagtgatagatcatcaggcattagattctcataaggagcacgcaacccagatccctccaagcatggttcacaatagggttcgtgctcctgtgagaatctaatgcagccactgatctgacaggaggctgaactcaggaggtaatgccagtaagcaatggagagctgttgtaaatacagatgaagcttcaccacccacctcctgctgtgctgcctggttgctaatgggccgaggactagaagctgcacggggtccgtaaatatctgtggggtaggtaaatatccaagcagtccatggcctgggaattggggatccctgctttatacagctagctttctataacttctaaagctgtaatctttctgttcttagcagttctcttacaggaaagaagacattgaactaaaagtgccttctataacttctaaagctgtaatctttctgttcttagcagttctcttacaggaaagaagacattgaactagaagtgcctttcccaattaaaaataaaaaccacagaacattagtgaattggttgacagtaatacattttgattatgtaaatataaattccataggctacttagtgattatttatttatttaccctgggtatcccaagaggtagtacagtggccacaggttatagagggcggtcttgagatctgaatgaggagagctctaattctagattttataatgcctgtggcttaacgccatcctgctctgcctggttcttcaagatagttgctacccccctcaaataattcaagccttggaatagcacagattgtgttagaacttcctgaatcctaaccagctagaatccactggcttgtttttgcgatatcagcctgttagaagcatatccctataaagatttaatatccctgtctctgcatcttggcacctgtgaatatgaaacaacagcataaatatgattttgaacgttgcattgtcacagatgaaaaaatgcaccaacatgtcaaatgcagcgctgaaaaaggaaatcgggcttatttttgtcgttgtttactgtaccaaagcatttttgaaaacccaaatcgaggagataaccgtttttgaatgaacggcagtgcaaagcgtggtcggggttagcagcaacgtggctgggcgcctttaactcggcgtgacctccgggtcccaggcccgcgtcccgggcccagcgcccaggcccgggcggcgcattggcccctcctcccctcgcgcgccgcgcgcattgttgtcctttagcgattggttgttggaccagaaacagctgtgcagagccgtgccatctaaagagctgtggacctgaatgcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggttggttggtgaccgcgtttctgcccccgggccggggccgcgggacgtgctcggtacgccgcggcccgggtgcttggaggagaggacgggcagtgatggatgcgataagttatggggaaagcaggaaaaaattagctcccatccaccattttgtacctcccaagatccacagcaggccctctcaatatggggttggagagctattagttaggtaaaacgagggaggggggacgagccgggcgttttggctgcagggagataaatgactgcaagccccggcgctgcagcctcctcgagctttgtggaggatcctgcgcccagggttgcctgcagtgccaggcttgctggctgctgcattgtggccggttatctgagtgggtatttccagcagccccctgttctccaaaaggaacaggttccatgcgcagctctggatgggctgagtcaggggagagtcctgcagacatcccaggctggtctgatttgcacgcagagaactgtgttggagcttactgaacgcgttctgtgggggtaatggtgtggatgcggattgaatgctcacatgattctgtgtggatttaacatatgttgctttgaattaggctgtatggaaagaatggaggctgtatcatgtgtttgcatgtcagacaggagggacaaacaaaacggtaaatggaaagggaaggcttcaaaaaagatttccgcttaaaatgcagtgctgtgaaaagccttcctgaaggagccagttctttttttggaaatacaacggaatggctttggtttgatttgggaacccagggatgaaattcttgagggaaatgctgaaggaggaaaagcctggaaaccttccgttgccttctccttacttctccttaaccacttggatgtaatgatgtgtaaggcatcggttcttatttatttttcattcagagaaaaatttagattttcttctaagcacactgtaatggaagaaccgagattttattttaaaccacatactgtaccaaatcactctgagccctgtcttaactgggaagatcattttaagcttgtggttggtacttacagtctagctttactctttttctcctaaaacagcaagtcctttttaactggggtcagcatctcatgcttcaaaaatgccttgcgaccgcatttccacgaacataaagccgaaataaaagaaccatcttttttattgcaaagtcaggcgacataaggatgttgtactattttggcaataaggctcccttgattttccctttcatgaaaagccaaattcgtaaagaaagtgacaactacagtttatacttcagtcatttaagtcgctgctgtggttgctacactcttcagacttgtggcagtaaattttgaaacacacctaaatgcaaacctaacctcaaaacacatatgtacataaacccattgctgcactaagtgttcagataatcctgggtttcatgtacttagggtttgaatgtcttcattccacacttcacagttcccctttcttatgcctcctaaggaaccggtcctgacaccaactgtgaagctataggagggttggtggccatcatttcatcgacaaacctgcaacactctgtttcatgattcaggcacatttccaggcagccagttttttttttttttttttttaatctatcttggcattacctcattatcacatttgcattctttgcaaaagaacttgtctgctattgcaggtgctgcgaggcgtttttgagggcttgaggaagaagcttttaattgtacttgattcccttattttatttcttgatctacaaatggtaagatggtcctatggtgataatgaaggataacctgtttcaggttggcggttttctgttcagattcaatgttaggttactgctgagaaacctgaagaccaaaagatggaagaaaagtgctgtcattcattcagcatttttatggcgtgcccccaaagagcgaagtgccttgctggattctcatggggttatagggttggatataatacggttcttgcccagggagggaggcttatcatttattctttattttaactgttagctaatacatggaataagaagcaggtgttgctgctatggaaggaaatggtaaacatgatgacaaacacctacaatgaagattgggagagtaggtggagtctttctcatgtgcaactcttttgggggttgggttgggaaggatgtgtatcttcatctatttcctttacaaatatggctcctttcaaaatgtgagtattgatagaaatagatgatatactgaaacacttggaaatgatttataagacattctcatccttttaggaaatgtaaaggagatccacttttatcaagttagtgactttggatacaaacagagcctttgtcacataaaatattgagtagaaaatgaaaccacttagaaacacatgaggcctttcatatttcttctttctgtttgttcagccatttggtttaattactactggtatccttatacttgatttttagtaaaaaaggtttttgttgtggggaaattacttgggttcaaaggacaagataagcctttcagagatgtactaaatgacttaaaataacttcagttaagagactatttttagaccccctccctcaacaaatattctgaaaattatgggaaacagtcacttagttttaaacttcaggacatgagagagccttgggaatttcaagaaatagatattaataattttccttttggtctagcatcccgtaccacacagtaggtgcttcaagcaaaattgtaggcttctataatagcaaatgagacagcaccatttcaaacagtcttttctccacgaataagtaattaccagtgtgaaatgtgatttatagcaataggcttgacatttagccttggcctttccgataccttcaggataaactacacttaagctcaagaggttagagcgggcacctataaactagcgagctcttgcaaaaggacagttagagaatgctgaaactttaagtctcgaagactatgccttatgtgactgtttaagctcccaactcatgctaccaaatctgaagaaatcctaagaattcatgagcttcctagcaaccagtaagttcacaggccatgagatgacttcattgttcatcttgaatattaatttcccagtggtggtttctgggcagaaaggggaagatcttgccttttgttcaaatcaagatgaataataaaaagtgcatggcgttatcttaagaagaaaagggattggaccaaatggatgtgggatcattcttgggcattttctaaaagtagaagttacgatattaatgaactagagataaaagcaaaactccccacaaaggagcaaatctgtataatgaacgcttagtactttatgtatgaaaacatgctcatttgtctctgtgaaatgattttcaaggccccaaaccttttgttgatgaagttgtgagagctttctctgttagaattatgtgaactgtaagctcttcacacgaatgatgctgctaacttttaatttccttccctctcccctcccccagccctggggatgggcgcctctttatattccatgtataatgccagcaaagttttgggggacatccttattgatcaagcatggaaagtaattttttcattatacaggttctacagcacatgatccttaaaagctttgtttctgcatgagaaagcgaagtcctggcccatttgagtttgatgcttatcattttgataacatctttaaggagtaaagcgtgcgtttttaatactacggttttaaagcctttgaaaagaaagataaaacaaaagccctaaactgacattgcaagaaatttgaaagcagttttgtctgctggggaagaatggccagctcatcaccttgattagtttattagttttcattttatagaaactaattctggggcacgtttgactgtgtgttccagttccttatgttctgttattttaagagacatgagggttttctgggagtgaaggatggacactggaggttccaatctgggcctgccacaaaccagctgtgtccctggcgagtaatatgacctccctccatctgtaatgagtcccccacttccatgctgccattacagaattgggctgtgcagtggctctgtcttgagcaagtgcaagacttctgaacacttacacataaattgttagacaaaacttctctgccctcttctactttttggagtcaggtgcctcctgtttgtgggaatagtgctcattttgcgatacaatcctattccctatcatcctgaaatgttacattaaaggtatgcgttttaggactcgccctgatgaccagagtaatgaggggggaagaaataaatgaagacctggcaagttataatcatatgcaagttttaataaagagcgtcctgtcacgtccctttccctctttgccgagatccattttcagcctagccgctccaactgtgttttaatttgaaactacctatgttgactcctttcatcaggcgagtggaagtgaggaatattacacttggtggtgaatgactttattctttatttcccaggagaacatgagtgggcttacaaaaggtcacctctcttgatatttcaatatcttttacattctttctaatgtttttatttgaaaaaaaggaatatgagtgtattgtataaaaaccttagcacttctgcacctccagagcaattctggcctgaaattccctacaccccggagaattaggacaattcagacaatggtatactctttggtacacggttgcttaggctgcatgcaggttataactaaaagcaaaatctgcttggacccttgccagtaggtcctatgctaacttttgaatttaggacatgtttttataaatcagtgatagagtgtgtgatgcctaatctataaggtataaagtagaggttcttctagtttgtgagagtatagatatagtctactccaaattgaccttatccacagtaacacaagaaagaaaggacatgggtaattttttaagtagggagtacacttttcctgaagtaggaaaaggctagtcttctttaacatcagaaggcgtgtgcaaccagtcagtcagaagattctatttgttcctcccacttaaatatttctaaaacctgtctcttcctcttcatctctgttgctgaacccttcttctgttctattacactatctaccaaacagacctctcttctggttccatctatcctccttatgtccccagagggctttgatggttttgttttggttttgttattttaaaatctctcctaaagcaaaatcacttgtgttgcttcccttcccagtgttcccatccatcacgcctgtggatgaaatcatagaccagggcacatcacagtataacctccctcacttttccacctcttcttctctttcccccactgttcacctcaccctgtgctctgggctctgggagctctttacctgcatcagcgcctgtcaccttgtgtacctgttgtagtttatgtgactttgcccagaatgcgttctccatccttacaggtctgatagaatcctctttagccttccagaaccagctcctatgcccccttctcttgcatcgtctctcagatcctttccagagtgattcgctcccacgacgtttgttttgtacttgtgttacagcaacacggtcacattgtgccacatcacgagtttacaacccatgtgtgtctccggtctggatggtgaaatcctcactgatagtacctgccttattcacatctctattttgccagcaaccacagagcttggcatgtatccggcacacagtaaatgtgtatgggatgagtgactaaaacatgacttcttagaaagttgaatgaggtctcgaagtcctaatgtgagtcacctttttgtaactgcagaaattataagtatgtatgctaagatcctacttttgaaaagatctcccattgtgattggtagacaggaccaacaagctatgagtggatgattagaaagtactaaataataggatacaatcaagagtcaagttggggtggttgatgtggttgctgcaagtgaaactggagttccgagaacagaaggacgttgcttagaaaaggctgcctggagggaggacttacttgggtcttgaagaagtgggtcgatttgaagagatggagaaggagaaggatttggggaaggttgaggaagcggtacaaaccaaggcatgaagctggaaatgaaaatgggtgtgtgaaatttgtcttactgtaactctgggatgtaaccagaaataatgtgtgggatcttgaaatttgggcggattcagagtttatggggtaggtaacacatttgtgatttggggagagaaatggtggaagcagcctttttaaagaggtgtcagatcgtggcttgcaggatagatgcatgttgtgaacgtctagaggctgggagaccagaggggaggtgtgtgggggttgatgtggtgatcaagcagtaagacgacggccatagaacagtgtgtcctgggccaggcgtggtggttcgcgcctataatcccagcactttgggagggcgaggcgggcagattacagagccaagagttcgagaccagcctggacaacatggtgaaaccccgtctctactaagaatacaaaaattagctgggcatggtggcgcgtgcctgtaatcccagctactcgggaggctgaggcaggagaatctcttgaaccctggaggtggaggttgcagtgagctgagatcgcctcactgcactccagcctgggtgacagagccagactttgtctggagtgtgggggtggaggggtcgagaacaaaacaaacaaaaaaactgtgtgtcccagcactgctaggtattattagcacaccaccctcaagattttaaaaatatgtccacataccacctaacctatttaatacttcgctttaacttgatctacttttgtatttaagtgaattaaagaaacaattttgcatttcctatgaaattatgggtttctctcgataattatatattttttctaatccctagtaaaatggacatttaattagttcagtaaaaaatattcaactaggtactacccagaatgaacccatgtacctgagcggtactcacaccatgtagtggaaaacctgagtaggccaagggaggagggatgggacaaggtggaaagggttatgaagaggaaagggagaatctgggagaacaaaggaactggccgttctttgtaagtggttgggtttaagaggtggaagaaaataaaggtgaacatggcgaaaccccgtctctacaaaagatacaaaaattagccacacttgatggcatgtgcctgtagtcccagctactcgggaggctgagcggaaggatcacctgagcctggggaggttgaggcctcagcgagccgagattgtgccactgcactccagcctggttgacagaaggagaccttgtctcaaaaataaaaataaaaataaaaattaaaaagctgcaactgattttgttgttgttggaagaatgcagtaaatgaccaggaacctgcagaaagtgagcagagaatgagttccattttgggctaatggtttggtattccaactacagagggctttcaggtgaacaataaaggcgtataagttgcaggtcatttgtgcggcagtgttcgttgtgaacacgagaatagcttggctttctgtgctttctgttccccttcttggaggggagcaggtgactgatttttatttccagcagaaggaggttcagttggattccatgaactcagagccctccttgggtttctgaaacctggaaactcgaggttaggattgcttggagattgtccgctttcctgttcctgaaagtaaagtgccctttaattcttggatttgttttattagtgttctcatctattcagaagccattgcattgttgatagaagggatatgtttttgatgtctatagtcaggtctgaaaacagagctctgcaagtagccgcacaaaagactaggccagctatgtaaataatgtatatttcaaacatctgtcatatacctatcccgttgaaaaattacggcttaggtaactcatacacacagtcaaagtctccatttatctttctactttaatccgtgatggcccctccaggccaagttttctttttctgaagataaaagagagagatttggcagatgcctgtgggcagtcggggtagcaggactattgcctggccttatccgtctgatggccgtagtttcagagggaggagccatcctctgcaattaacattgccttctcacccctacagattcctgtctggttggttcccctaagagagctaatatgccatttactgctttcggcatatccaacttttgctttgaaattgtctcgttattagagaaaacgaaggccgccagagtgactgaggtgcatggggtatttgtcttttttttttttcctttttggctgcccagtatctgaacctcttttcgatgtcggtgtcattcctcattgttacgcgtcgaatgtgtccgcccaaaagataggttcaagtcctaacccccggtacctgcgaatatgcccttatttggaaatcaggtcattgtggctgtaaccaagttaagatgcagcagtactggaatagggtgagccctagatccacatgactggtgttcttataagaagaagaaaagagacacagacacaggggagaataccatgtgacgagagaggcagagatgggagtgatgtgtttacaaacgagggaaggcccaggaccgacagccaccaccggaggccgggagagaggcctgggagggcttcaccctcagggtcccggaaggaaacaatcctactgacacctggggtttccacttctagcatcagagctgggagggcacatatttctgttgctttaacccacccactgtgcggtgctagttccagcggccacaggacactagtccgccacctctgagccttggtggcaggcagcgcccgcattctctgtgaagatgctgaaattgctgtgtaggtactttcctggccttccttacatggagggcaggggccagagacctgggttccacccagtggatattcccttcctgacttctaatctggtgctagtaaggtaagatgatggagactgtgagacagagtcccgggacgtggtggtgtggcatgatggcgttcccgggccaggggtggcagccggcaggtggtgccccatgtgccttgctagtggtgccagctgtaggtttgtgcttggtggtggctgtatgtttcaagcctgggtctccagccctccctggaatccttgagttgctcagtgtattttactctatccttttgcctgagaggctgtgtagcatagtgatttagagcagagatgcggacctcatggcttggcttcatagttcaatgttaccatcactagccaggtaaacttggagaaatcacttattttctcaggacctcggcttccttacctgcaacatgggaataataatggtacctaccccttgggctttgggtgaattaatatgtgtaaagctcttagaaccaagcttggtacaatggaagcattatatccctatgactgattttgtcattaaaagtaatggccaaaactgcaatgacttttgcaccaacgtaatattaaaagagccagcatgggtataaaactgtagaatcccatcagacacatatatagaatcacaacaggatctcgatcgttgtcacttcaaagtattgatataaagagtgacttgcacagaagctacacaaaaaagtacagttgagttttactttgcaaccgtgtcgtcttcctacggtgacctttccagaacgcttttgttttcccctttccaataacaccctcttccctctacttcctatctgcttcctcctagagtttagaacttagttccttgaggaaacctgatggagtgtgaccgagccgctccttctctgtgctccggcagcacttcttgcgcacctctgaaataaccgacacatctgccattttcttgtctgaccctctgtctagactggaagctctttcaggccgtggctcgggtctgacgtggctttgtactcccagtgtctagcgagtgccagatgtgtagcaggtacacagcagtttaaatgtatagatacggggacacatggtcttgctggcattcccagtggcttcagtggactctgtatttcacatctttctctaaccatatgcgtggttgatgccccaggggttgatggaaggaagccaccagggtgattgtggtggatcggtaatcgtgacccactcacaggggcccgaaggagcaaactgaaggaaactggggtagtttagctgtaaccaccgggttgtagagatgtgaactttggttttaggatttttaagaattccggcatggatctttggtgaaattataaaacagtgtcttctgaattcaccaaacgtctaagataaaacttccatttagattagatgctagagcttgtgattggaatgtgcgttctgttaacctagtgaactcatttggattttcatttccattggttttcaaataactgaaagaagtatttggacatattttccccacacttgcaaactggctgtttataatgtagacaaggggcagatgtggataactttttaacagtgcttttaaaaagactgcttagccagagagtgaacacgtcccagagagcagaacagtgaagatggccatagtgtcaagtggatttttccttatttgtgagagtggcttctgtctatgttcatcaaatgcctttatgtggtaaggcagcgctgtgatttagggctgtgaaatcagacattcatacattggtgctggcacccacttgctggctgtgaaatcctaacaatctatgttatcagtctatcctctgttttcttatatttaagatgaggataaaatagtatctaatttatagttgttaaacgtggattaaatgagcaaatgcaatcaaaataattagcatagtgcctgacacacagtaagaacctaatacatctttgctactgttatttcttttggaacagaactatacaggattgactggtttctaagtgttttacacctgaggatgcagaagaagagagccagcgggcaacttgtctagtgctacatagagttaaaagcggctttaaatgggattcttcgcctgatatttggtactcatttatcagaaatcaagtattccatttcttactgattttggtatgtgctctgctaaggaaattcacagaattattcatttatccaagtgggctcatttgtccttgaacttccaactaaggaaaaatggtagagaatcaccgtgcagtcagtgtagtcagtgttcccgtggaatataactctaggagaacttggctttacttaaaatcagggaaattgtgccccatataatcagacatagcttactctgagatacttattttgacttttcagttgaaggtaaaggagaaaactccgcttctgagctgcgagttcagctgcgtgtttatgtgtttgcatatgtggtaaaaaccaatcttgcagaagcacagttgagaggggaaagctgtgaagcgaagggacatctttcaaggccagttttgaaagtaaagccagtaggctctctcctgccaaccaagtgcatgttcctccttcggtgagtttataaaagtagtgatgggcccagtggaatctcaggtcagcacggcctctgggttgcttaggaaataaaggagggtgctagaattggaggtccactcttcacatgtgttaatatttcagctgctacgagcagacggtttggcagccaggcctggggctccgggatgacggcctgagctggaggagcagcgtgggttttccctcctgcacacacctcctgtgaacctctgcaccagccaggatctgggagctcaaagctgcccaccttcgctgcatctacccccgagtttccatgttacttattcatttgcaacatatcctttcccttccttcaaatcaagggaaagataactaaagaaaaaccaaaacggtacgaagtaacttgctttctatggttatgcccaactaattgaacttggaaagcctgttctacttatgattccacaagtattggctttctttagtcaaagcatagcttctggagcatgcagatcttgtttttccatatggtgtacgctgcttgatgtgggtgatttaaacacatggagagttacacagaatgtttgtttgggatgccagaggcgtagtgaatagtagtgtaccatcctggcctaagggccagaagtggaggtttccatcgtgagatgcagccatgtgcttgcaaggcttcctctccagggcagcgcggtggagtgtgcttgggctgggactggccgtgggccagctagaggtggggtttatggttccgcagtcgtggagtcaggccccgccgggaggtgtctgttaagctcggcagtggctcaggcctgggatgtaagcacagtctgagagcatgcttcctacgtgatagtggagtgctggtgtgctcctgaaatgtcagtatggaaaaggggcctctttaccctcagctccctttcacctaaggaaggaaaccattgttgttattgggattgttttttaagatggtctcactttgtcacccaggctggagtgcagtggtactatcgtagctcactgcaacctctacctcctgggatcaagcaatcctcccccctcggcctcccaagtagctgggattagagttgtgtaccaccatacctggctatttttaaatttttttgtagactgggtcttgccgtgttacccaggctggtttcaaactcctggggtcaaggagtcctcctgccttggcctcccagtgtgctgggattatggacatgagccactggacctgggtggaaaccgttgtttattgagcatgtacttggtgtgttggtacctgtgtaagtgtcaccttgtttagtcctcacagcaatcctgcaagggtgccactgattaatattttagcaacacaaatgtaaaaaaatttcagaaaactgagatttcacatactcatcggtatacttttaatcatgttcagtgttagtaaaataacttcttatttttatttatttttatttttattttgagacagggtcttgctctgtcacccaggctggagcacagtggcaccatctcggctcactgcaacctccgcctcctgggttcaagcaattctcctgcctccgcctcctgagtagctgggatggcctgccaccacggccagctaatttttgtatttttagtagagatgatttcaccatattggccaggctgatcttgaactcctgacctcaagtgatctgcccgccttggcctcccgaagtgctgggattacaggtgtgagtcaccagacccagccttcttatttttaagtaaagtattgaatactgtttcattcccccagtggttcatcttgcacttcctctaagtggaccccactgtagaagcctgtgctgtaatgagagagcagattttagggctccttgcatattctaacaagtctaaccctaaatatttgggtatgttatttaaaaataatctcttcttagccagctgaggttcttctgagaattatcttgccttacccaaagaacaataaagcctcctaagatctggtaaggggcaggctgggggatttgctgagtgtttccctgctgctatttcttcctcttcctctttttagcaccttagagtgggtttcaaatgccattgtaatgccgttgtgagctccttagtcgtcttaattggcttagtgttatcatgagctgccaatcatgtagtgaacatccctgattcctggagaagatgagatagctgggaccaaacaactcctaggtcttaacgcatttagtgcaaaggtacctgacaacaaaatttgaaacatcaaatgaaaagaagtctcaaacataaacataatttcgttcatttgcaaatcatcttcttttgcttactcattttctcttgtatttttcttgacttttttagttatgaaaaattgctgaagaagcattcggtttagcacagtctaatttctgccatctgttgttgtaagagttagaccgaacattattctgaggatagcaggaggctaggatctatgaggatagcagtaggctaggatccaaataattgaacaatttgacagtacctggcacagtaattcaaaatgacagaactgggggcaaagaagaagttctatgggtttgcatggtgtaagataaaatcaagttcaaggtaatcaagaaagaaattaataaactaggaattttgttgaatatgattaaaaactatagatggttaaaaattgggtaaaccaactgtatctttgataaggatcagtgaactggtttagagtacattagatgtatattacaaatcttccttttgggggaaaacaaaaaaaaagtgtcctgtgactccctgtaggagggtcagtctgagaaaatccgttacaatttcctccagcatttcagtggtccaggaggatgggttcagtaacccatggcaacccagtgaatgtgggtaataggaaaacataagcttcattcagttctgttagtaggaggacttgcaaaatctagcacctacataatccttggaatgtataagatttaatataatacaaataaaggaaaccccagctctttagaacatttaagaacagtcacaaagctttatgaaatacggtatatatttctaaaagaccaaaattgcttttaaacaatatataatagttaaaaatgatatcttttattaactcttactcccgtttcatggctagctaactagctaacacttaaattctctgtatactatactaaagaaatataacacaaagttgtcagcttttaactaaaaatatgatttatagtttctctgtatttttaactttagaatcaatacaccaaacgataaactcgtaaaatgaaaaaggtcaaacacttgtattcagtttcctaagatgagaatttcttaattatttgcatgtctacttaacttcttattgtcttcctctttctaatgatattctgggagagatttgattagtaaactacctctttagagcaaagggttttaacgatttacagcacattaaatgtatagaaattgcattcatctgagctagatgactttcctcaaattcgctgttccctggtgctttgagaagatgaatagtttgttcctcaggtgcaaatattattttaactgtttagattcatgcttagtcatgcatttttttaaacttactttttcaaattgtggtaaaaaaaaaacacataatgcaaaagttaccatcttaacttttttttttttttgagatggagtctcgctctgtcgcccaggctagagtgcagtggcgtgatcttggctcactgcaacctccacctcccgggttcaagcaattctctgcctcagcctcccgagtagctgggattacaggcgccccccaccacgcccggctaatttttgtatttttagtagagacggggtttcaccatcttggccaggctggtcttgaactcctgaccttgtgatccacccacctcggcctcccaaagtgctgggattacagatgtgagccaccgtgcctggcacaaaagttaccatcttaactttttaagggtacagttcagtggtattaagtacattcacattgtcatgaggccaacatcagggtgtatcctgggaactgttttcatcttgcagaactgaaactctgcacctattacacactaactctcggtcctccctaccctcatcccctgcaaccatcattctactgtctgtctctgtgaaattgattaccccacctcatctaagtagaatcataaaatatctgtccttttgtgactggtttatttcacttagcatatcatcaagtttcatccatgttgtagcgtgtgttggaatcttcttccttgttaaggcagaatcgtattccattgcccacgtgtaccatgttttgtttattcattcacctgttgatggacatttgagttcccactattttgctcttgtgaagaatgctgctgtgcacacaggtgtacaaagaactggcaagtccctgcttcagttcctttatgtacatacccagaagtagcattgctggctcacatggtaattctgtttaacttattttgaggaaccaccaaaccgtttttcacagtggttgcaccattttgcatacccaccaacggtgtacaagggttctaatttctccacatccctgacaacacttgttattttctgtttttttccttgatagtagccatcctaatggatgtgtgttcttagtcatgtatgttatgaagtacactcatagctccatgctgtggatgatctgtcttctctgagaagttagaagaaaactggagtgatctctgtgttgtctgctgcacagagaaacatgatcagctggagtctttcttagaaggccgctgtcacttgattaataaccaacacggaaggcagaggcagagcagaccaacaaacgtgctcctggtttcttgtgcttgtatttgaatactgttttcttatttttttccaagcgagggaaatatttaaacacaggcaaagtacacttgtgattctttaagttttatccctgtttgcagtgtgtgctatgaggtagtgctgtgggatgtaaccatatgggcccttcccaagttgcttaaaatgtagtgaagagcttagaatatctttaggggtgagctgcagaaagtgaggtgtcagatgagtccttacctggggctgtgaggggtgtggcatggagttgtcaggctgcattcggcagggtcagcattgagttgactctgtccttgtgttctagatataccctccggaaggtaggaacactctgtagactgtggttcctagacaccatctgtggaccagcattgagttggttccttctgcagaatcatctggggaacttaagcagatacacatgttagcctcattccaaagtatttgtagcttgggatggggtccagaactttatattttcaaagctctcgaggtgattctgatgtacagttaggtttggtagccactgatttggaattgcctgtccaggacagcagcctctcagctccttccttcaaatcctcactgcttcctcacaccttcagcaaaccagcgttgcctgttcgtgtcagggccttgacacgtatgcttgtcttattaaagagtcaggatccattcttgccttgaaggcccccacagttggctggagatatacaggaaaccactgcgggacagtgggatgagggtgatgatgggggctgagtaaggggggctggacccccacagagactaggacatgggaaaggacttctgaggaggcacaggagccccgtgtctgcccttggaggggcaggcagcccagcaggaaaggacaagagaggctggagacaggaggagtcccccaggcagtgccctctctctggaggccagcagatgagagagacaaggcaagagagaggaggggctgggacccaggaggaccttatgtttcgagctgaggagctgtcgggttattctgagcttaatgagtcccagacagacttgaggtaggggagtgacatgttgggatttgcatgagagggagatcgccctggctcagggtggaaaatggattgtagggcctagaggaagaaactgataggccggcagtggatagagataggctcgcaagggtgacagggccagaatgttgaggaattccatgcctggcggtgcctgtctctaccttgaagcaggaagttggctgcaagagttggaagaggtcatgggcaagataccagagtcaagatagctgtgctggcgtcagaaggtacatgcgtagacctcccttagagagtcttagggaggcctgctgaggccggataccgtgaatttgtggtggccttaatttgtatgatgagtgatttttacatgtagcggtctataatctgagtgcaaaagtgggagtaccaaacatttggatttttctaggttttaacactttgccaagtagaaggatctagagtaatgaggaagttgaggtttctttttctccccgtgttttaatcttcgaatgaagccagggctgatgggatgtctcctttgggggtttgttcctagtgaaacagaggtttggtatatgagaaggtgaaagcacaggtttggtatgtgatactccttaatcttctgaatggttctctaatgatggtagtctaaatactcagaaaaggaatccaaattgaaagaggtacaacgggtgaaaatttgaatcttgatcacaaactgtcatttcaaactcacttttttttcggtagagttggggtcttgctatgttgcccaggctggtcttgaactcctgggctcaagagatactcccaccttggcctcccaaagtgctgggattacaggcatgatcccccttccccggcccctcccccggcacacttgcaaagttgcttgaagaataattccagttggagtctattatcatgaagaattatttctgaaggacacttgagctcttcttaagctctagtcaagaaaaattgatcacctaattaagcttttgtcagatatgactttctgtgtatataatgttccactagacaatgtaatacatataactaggactagaattgcactaatttgggataattgggaggaagacctgtctaaataagtaaaagatttaaattttatagaatgtttaatggaatgcagtcttattactttcatgtccttaagctatctaatgaatggataaattatttataattagcatatcaatggttctactaagagattgctccttttagtatttgaaaacagggttttttttttcttcttgaatcattgatatggtgccctgaacttttatttatggcagttatttgtcctagccaaaggaaaggtaacctttaacctggccctatcccatcatcgccaaactccaaattggtaggtttcgaattaacatgaaattttattacatgggagaaccaagtaattctgcatccttaatgacacgagtctttttcgttttaaaaaagaaatctgtatttccatcacctatatgagaacagatgtgtttttaaaattcagaggaaaaatacacaaataaatattcaagataaagaaataaaacagtcaagatacattaaaaagtgcagattttaaaaattaagaaaataagataagggaataataaacataaaaaatataaagcattcaagataaacactcaaaatgataaataagtaaatatccaagaagaaataagtaagaaacacgtcattttccccaaagaatattttagaattcctgataataatgttttccacttattgaggccctcataggagccagtgatattctttcatttaatacaacacccaattctctgaggttggtattataattatatcagtttactgataaagaatttgtggttgaacattactagctaattaatggcagagctaggattcaaatctggatctgctaacttttcttaggacgaacctttagtacttcatcttccaatgtataattagagtaaagcaaaagtgggttttttttttttctttttgagacagagtcttgttctgtcacccaggctggagtgtagtggcacaatattggctcactgaaacctccacctcccgggttcaagcagttctcctggctcagcctcccaagtagctgggacttggcacgcgccaccatgcctggctaatttttgtatttttagtagagacggggtttcgccatgttggccaggctggtctcgaactcctgacctcaggtgatctgcccgcctcggcctcccaaagtgctgagattacaggcgtgagccaccgggcccgaccacaaatagtgttttttaaccagatctgtaaaaagtttaggagatggaaactgggcaaaagtaaagtattaacctactcttaacagaaaggaaaaaatgctattggtgcagaagtggcagcgttcgggaggatcaaaacaacacatcatgatgagtattatttcctcattgactctgattgcttttctagccagttattgattctttgcacacatgtagacttttcagttggttttctgaaagcagagccaacgccaaatagtggcttgaggcccggatgtgggagcaggctggctgagtttgggcacaggctctgcacggaaccagctgtgtagcctggcccccatgcctggcctctgtgtctcatgtgtaaaatgggacaatagcagcacctgcttcatgggattgtttgaggatcaaatgccttcatcaatgtaaaaccttgaggacagcaatctttgatttaatgttatgtgctccataacagtgaacagttattgttattaataagcttatagtgtcagtttagcaagaagcatctttgggcctctaaaaaagggtcatttatttctgagaacttttggggtctttttttttttgaggtgggaaagacttaattgccggtaattacaatctcccctgacctataggagctgttttaaatagtgtgtttaaaatagattggctttgcaggctagacgtggtactttttcagtgcacatattactgagctggaaggacccattaggacttaatggtcaggaggttgccaactgatgtttttgataggaggtaggagggtgtgtgagtgctggtgtggcattctaacaattgccttcttttgccctttctgggacttacccagggctttacatctatgaggagccattgtcagtctgctctctcttcttgcttaggaggagaacagacttaccctgtttctccacttgcaggtaagtgagcacacccctcagcagggcacccaggcatcccaccaagtggccgggaaacaaacctggctctgcgcccctccttgctgtggtcggatggtcttgcagaggctgtgataggaccagcatgatggtcaggctactcaacagagaggatacaactgcagaatctttccagatgaacagaggtgctaaggatccctggtgtattatttcagtggttccattttgcattgtttgcttatgggctttgtggcagctttttttcccaacagattggtgttcagtttaggtcatctgttttaagttcatttgtgtctttcacgtgggtgaggatggggagccctcgggggggggcattttgtatctggtgtacccttctgttcatctctgcacctccccagagctgcccacgaaatgcttatagcccccatggtctcctttctgtgcagaagataataaactgttggatttaaaacaaaatgaaacagcaaaaaaaccacacaaacacaaaagcctacttcaatgtctgcaggagcttggattttgcccccttcaagattcttgagaaacgtatctttcagctggagaatacagtgaagagaataacagaggagagccttggtgttcaaggatttatcagagatttcaattattaacgggtgatcaggatggaggtctaggacaaacttgcaattttgctgaggcacaaaaattttaatcccatgtcctgtgagcgtggacctgaatcagtaacccagtgagccggccgagcctggcactcttgccaacccggtgtatctccacgggcctgttctcaaagttctgagacaggaggggattaacaacttagtgtctcaggaggcagaggttgcagtgagccgagatcacaccactgcactctccagcctggcgacagagcgagactccatctcaggaaaaaacaaacaaaaaaaaaacaacaaaaaaacttggtttctttttggaaatagtcctgaaaagaacaccaacccaccacagctgctggtgataagaaataagagaaaatgacgatgtctgagaaagtcatagctcttactcaaaggaaaagaagctttggataaagtgtgaaatacttgtaacacaagccccgaaagcgtaactcctgtaaccgtctcgagaattcctcagatgagtatgtttcacttgccgtcttaattttaatacaaataatctttaaagatacaaggcagtaacttaaaatttttagttattgggaaaattacatgagatctagtcatgatcaaaaacatggagatttgctgaagtcttggggcctcccattgctcatggctggtttcttttctacagcatacaggatgagaccaaaagagttcagagctgtgccccaaatatcaagtacacagctatcattaaatcagatattttatgctgtttttgattttgtggtggtattggccttcctttgaataatccagtaaagatttagataaacgcgttaggaattcagggaaaagaacggcctaggtctggaggtttggaagtagtacacattttctctttatatgacattacgtgtagtatgttgggtcattgccatacctgagtggagtttggggacataatttataacaataaccgattgattattgggtatatttcaaacaccttaagtgagactgagaaagtgattgaatctctggccatggatcacactgggttcttctgagccttttgtaaacattaaaaccaaatgaacaaagaggctcttgcaggggattcataactctcacttcgcgctgccattccacataaaaccaaaaaaaggaccatttagcagtattgtatgctgaagggccacagcatcgacaagctcccggttaaacgtatttctgaggtacaacagctgttttgttgatgttatgttcactgctctgtgaataattttgtatagcaagaaaatattacaaccaattatcctagctatataacttttttcttcttcttctttgagacggagtctcactctgtcgcccaggctggagtgcagtggcacgatctcggctcactgcaagctccgcctcccgggttcacgccattctcctgcctcagcctcccgagtagctgggactatgggcgcccctcaccacgcctggctaattttttgtatttttagtagagatggagtttcaccgtattagccaggatgggtctcgatctcctgacctcgtgatccacccgcctcggcctcccaaagtgctgggattacaggcgtgagccactgcaccaggccaactttttttttttttttttaagacagggtcttaccctgtcatccaggctggagtgcactggtacagtcatagctcactgcagccacaaactcttgagctcaagtgatcctcccagctcagcctccagagtagctgggactacagacgtgcgccaccaagcccagctaagttttttatttttattttgttattattttttattgtttgagacagggtcttactctgtcacccagtctggagtgcagtggcacgatcatgcctcactcctgggctcaagtgatcctcctgcctcagcctcccaagtagctgggactacaggtgtgtgccaccatgccccttttttttttgttttttgttttttttttgtatttttcctagagacggagtctcattatattgcccaggctagtctccaactcttttgttcaagccatcctcctgcctcagcctcccaaagtgctgagattacaggcgtgagccattgctctggccataacttttgtttcaagaaggaagttagtcttcaatattctgttctaaagcttaatagaataatatgaagctatatttctttccctctgttttggaggaagagctcatattttttggatgctgtaactcagtatttctgaataacttcaatatcagttgaaatactgacctagatctacaaattttctttttttcttgcatgatattcctagaatcttatgtggtttctacagatatcttcaaatcaaagaggctgagcataagccatactggttaaaatagaaatttctattgggggacaatgaaagtgtctttgttagtatcaaaataagtcttaaaaatattcatctagaaactgtcatgtttgttcttgttaagatgattgtgttgaacccaaagcctagcttgttgagtaatttttccttgtaatttctcaaaagatcttcatttatcatctactataatatattaattatggagctactggttgggcacggtggctcacacctgtaatcccagcactttgggaggccgaggcaggcagatcacctgaggtcaggagttcaagaccaggatggccaacatggtgaaaccccgtctttactaaaaatacaaaaattagctgggtatggtggcatgcgcctgtagtctcagctacttgggtggctgaggcgggagaatcgcttgaacccagaatgtggaggttgcagtgagccaagattgtgccaccgtactccagcctgggcgacagagtaagacttcttcccccagcctccccccaccaaaaaaactgtggagctaccatattcctggtattatcttctgttgatttattcagagatatctagtgtctatatgcaagcaatatattagttgcgaagtgtctaggaacagtgaaagacacaagtctcctgtttacttagattatgcagactattgtgaaagaaagggactgaaaggagttcactataccgtaaaggtagtgtggcgcaaggtgaatgtgagtctgtagggtaaggtgagtcaggaagtgccttgtaggttggatgaccttataaactggcatgctggggccagtgaaagagggcactattaataattgcacgagaagagcaggcataagctgcaaccatcccaggcaaatgggaacgtatggttaccctatgcatgagggtaaggaatttgcatgctcttaagaagcagtaaatgagaaactgtagagagtgtttaatctagagagcaatataataaaaatttgcattgtggaaggcagagaaggattggagcgggcaagaagggaggcatggagaccagggaagggctgtttcagggatccaggcctgggaaggagacagcgtggagcaggtgatgatggtggagaggctgagtggtgggcagagctgagaagtgctttggagactcagctgactgacaggtgtcagtgactgtgaggatgtagccgatgagtaggaaggaggagtcaaggtgatacccagtttctgagaaagggagaggtgccatttgcttggatggaaatgcatgaggaggagcagctatggggttggggacgttgatgagttccattttagatatgttgagtttcaggtattgatgcaatatattgatacaatatattaattgtgtcagtgtatacatacagtatatgtatgtatacatacagtatatgtatgtatacatacagtatatgtatgtatacatacagtatatgtatgtatacatacagtatatgtatgtatacatacagtatatgtatgtatacatacagtatatgtatgtatacatacagtatatgtatgtatacatacagtatatgtatgtatcagtatacacattaatggtgtattgatacaatatattatacagtagaaatgtttggcaggcatttttttcctttctgtgttaacctcaacatcagcctgcccataccaatgttgttatttagggcttttaatccctgtgaagatcttgagcacctagacttgctgtgactcacttaagggctcatgtcagccttgaatatgaactgttctgagccttgtgaaaagtagcatggctgctctgttgaagcagctgaagtttggctaggaaatggggaacccgacttcctacaacaacgttgtctcccaactccctgtcagaactgtggaagatgtgggtgtttctgcagctttagaactaaagaaatgtcctacatgacagctcctcctcatctgaacaatatttatagcctcttgcagaatacgacttcaaaaataactagtatttataaggcacttattctgcagagcttgcctctatttttccatttttccttagaatccatacggagttgtcgagaggcagattcacatgctaaatgaccatgaaaaatatataaatatgacattgctttctgaatggtttattagttaatgttcgtattagccagtgtttacatttttaatgtgcatcaatagaaaaatttctctttaagctcctggataatttccgaagcagattatctggctcacgtacaacatttattggagtttgtggacagacacaaataccgtgcctttccccagtatattttaagtgataccgatttactttaatactgcagatttagccaaagacgtaattgggaatggcttttcctaagcctgtctagttcttattgaaattaaagcatttgcataaaaagctatacagtaaaccccagaagttgttgttgttgttgttgttgttgttgagacagtttcactcttgtcgccctggctagagtgcaatggcatgatctcggctcactgcaacctccacctcctgggttcaagggattctccagcctcagcctcctgagtagctgggattacaggcgcccgccaccatgccaggctaacttttgtatttttagtagagacggggtttcgccatgttggccgggctggcctcgaactcctgacctcaggtgatccacccgcctcatcctcccaaagtgctaggattacaggtgtgagccactgcacctggctgaaactcagaagtattaagacattgtaaattatgcccaacttgagtattgctaacaattacatttatgaggtaattagaattgtagtatctcctgttttaaagagcatttattatttatactcagcttcatcctgcctccctgcaaaagtatttaagatgtgttagggagacacatagctatcatgtgatgaaaaaaattaaatagtggaaaaatggacagagagaataaaaataggaaagtaagcagaaggtggggtgttttaagaattaagatgtgctggaagaattaagaaattcagacttgattctatctatttaaagatgtaaatattggccaggtgtggtggctcatgcctgtgatcctagcactttgggaggccgagacgggtggatcacctgaggtcaggagtttgagattagcctggccaacatgcaaaactccgtctgtacttaaaatacaaaaattagccgggcatggtggcaggtgcctgtaatcccagctacctgggaggctgagttaggagtatcgcttgaacccaggaggcggaggttgtagtgagctgaggtcgtgccactgcactcctgcttgggtaacagagtgagactccctctcaaaaaaataaaaaataaaataaaataaaataaagaggtaaatgttgtatttaattgaaaaatttctgtctctctatcctgaatgccttggcccaacccctttgtcttaaatcaggaaatggagaattattcaagcaattggatctaagtatataaaggcctttagaaactttagatagcctaactttcttttacctttatttctatatagcctgtcttttattcttgtctcctttactgacttatccagttgtacagcaattaatgacagaattaattaaaacaaatatccagaatctttcactcaacaattccttgatttagagcagcagttcttggccttgtcagcctcaacgagcctcctttttttttcaaacaacaacaacaaatactttggtaatgcttcttttcttatcctgaaatataatttatctacacacataatttcaaagaatcaatatgcatcttaattgtaaaataaatgagaaataagaagaatgtagcttatagtaaaattaggtgtattttcatatgtacctgcttagataggtcttcaccagaaaatgcaggaagctgccagctgcttcgcctcttgggggtatcgctatgaacgcacaagcaggctgactcctcaggttgcatgggtgcctcaggcacagtcatcgccattgccattggcgacacaattttctgaaacaagaatcaactcagtgcaatatttcaaacaaagcaaagttcagtttgttccatctccagttgtaatcctggaaaactcagcttttattaaagccggggaaacagtttggtgtttttatgtaaaatggagttctgttctaagtgcagataattacacacagatactccccagcatggatgtcccgcaggacagtgggaagcccgctcaggagcgtgcattctggggcgccaccccatgcgtgccctggaacctcatctgctaagtaccagaggcactctctcaagcaaaactgcctcaaacatacctaaaagctccccagagggtatcaccctgttgaccagaaaaaggggaagatgaaaaaaaacaactggaagatcgtatttaggtttgtctttcccttaggcctggaatgcagcattttggggctaacgctctagagaattataagggtgaataagtctatctgcttattccagaaagagtcaaagggaaactgaagtgagagggacagaaggccagggctgaagatcagaggcagggcccaggggcccagcagtttggtagtgtggggaaattgaactgaactttgaattctagccctgtatcaaatgtagctcccatgtagctgtatgatcttggaacaatccttttaaactgagtctttcttcacctgtagaaacaagtacttattcctaatttatagggttgttatgagaattaatattaatgggacagtagtgcattaaagtaactgacattgtgcctgggactaaggagtactcagaaactgctagttttctctgctcccctcttctcatgcagagatttctagtgatggtgtttgcatttcaagaggagggatgtaagagtgataacaaagtgaaatgtttagttcctaagttttaaggtggaaaacctgatatacagtactttatataccctgaagcatcctaaatttttttgttgaaatgaaccctgtgcatttcagatttagattttgtatttcacgacattcgtgggagaaaaagcgttacttctttaaatgacaaaagaaatgctttcctgtaggaacttcaaacaagggacatataaataaatttcaacatgaaatcttcaccacccctaatccaacttcctgagagtaactaactactaatagaatttaaatttaagtacttctgcagtcttcctccaagccttggcaaacgctgttgtttccatctggagttttttttgcagtctgtgtgaaaccttcgctctcatctgtgctggggaagctatagcctcgtgtagcctagcctagcccacctgactctactcagcgtaattgcttcagcaccgcttttctttgtttgtaaggctgtgattgatggatatcaatttttatttctcctgtaaggtttttgcatattttctctcttttttttttttccgcagtggatcatgagtttattggcgtcagtatcttttactttattgtaaggcctgatagtatctttttttttctctataccaaagttgctcaaaattggaatatattgaccaaagcactgaattgtgattatacatgagtattctgtaggcagaactgtgtctgaagagaataaatgaaaaacctagattttaagaaactaataattttttaaaaactaagaacttaatcacaaagaagcttatttaaaggagaggtataggtgcatggaattgttgaatatttaggactgccagcctgcctgtgttctcagaggtataccatgaacaattgtgtgctgagtcacagtttgtcttatttcaaaacttcatcagtactatctgttgtaaccacttctgtgtcttgcaaatgatatgtcacctcactttcattctgattaatgaaacaagggatttgtaggaataaacagttcttaaaatatttggagatataatttggtgggcagagcatggatacttttgcacatcataagttttcattataaagacattatcttactcactttaataaactttgaaatgggcattgtaaataaggagggaaataattatgacagtatcttgaattcacacatgcatatatttttatgcactcagggcagtgtatgcatgtctttgatgtacagctaaagcactctttggtgaggtacattcattgtgcctttcctttcctgtgagtcacggcctacctaagagaaagcttagtaacacgcaaggaaaattcaaaacacattgaggctctttaatgtacgtgatacttcagctgagataacctgtcatttaaaaaatttattatccagaattctcctagttaatgtcagtttcctgtttagacacagctttcctgaaaggctgtaatcaattcttcatccatcctgaaggagagaatttccaatggagagaagacgtgtcttcttcccttatttccgacgctcaggaagccatatgaccttttctttattggatgagaccttggcacttgcttagggaggtcagtgttcgttttagagctgctcagagtggggtcggcagacaggtccacaaggacatatatttagaaattgagagtaggcattgaaacaccaatagcagtttgatatttcaccaacatccaagctcatgatcagtggactcgtctcattgagctcattcaggtgtggtgtgacctgcagaacagtcacgctcaggaccttgttcacaacgtgtggcgttttaaggttagcttctatgatccagaagtatggaaaccattgatttcatcaatagatgatgtaccattaactaacttgactgaaaaaaaatttggaattgattaaagatgaattttgaaaatacagtatctctggctttattttgagtaaaagttaaaaaatcctgagctggctgggtgctcatgcctgtaaatcctagtacttttggagtccaaggtaggtggatggcttgagcccaggagttcaagaccagcctgggcaacatggcaaaaccccttctctacaaaaaaatcagaaaattagccagatgtgggggtgtgtgcctgaggtcccagctccttgggaggctgtggtgggaggatcgcttgagcctggaaggtcgaggctgcagtgagctgtgattgcgccactgcactccatcctgagcgacagaatgagaccctgtctcaagaaacaaaacaaaacagttctgaacttgctgaaattactttaaaatcttcttccattctccttaacataccttttgtgagactggttcctctactgtaactgttattaaaacaaaacataaaagcattttagatacacattattccctgcgaatagcattgccatcatccagtttgtgttagtaaattaacatgcaagaagcaagctcatttgtcactttaaaaaactttattgatggctgagcacggtggctcacgcttgtaatcccagcactttgggaggccaaggtgggcggatcacctcaagtcaggagtttgagaccagcctggccaacatggtgaaaccccgtctctactaaaaatacacaaattagctggatgtggtggtgcacgcctgtaatcccagctactcaggaggcggaggcaggagaattgcttgaacccaggaggcggaggctgcagtgagcggagatggtgccactgcactccaacccgggcaacagagtgagactccgtctccaaaaaaaaaaaaaaaaaaaaaaaaatctattttattcccaaagttcactctttcaaatgccattgctcctgtgtgccaactttgattttcaaagctcaccattaccttggagataacgttgtgcctaatttcaggatgattgttttgaaatgcattttcgaattttttccagccttgcacttgtagcatccgttgctacatttcatcagctctgattaagaatgctcatcttttaatagcctgctaatgaaaataaaaaatttgtaaagtaaaataaaaaatattttattaaatgaatgattttaaaaatgcaggccattaataaaatctatccaaagagtcagctccttgctacatacggaatagaagactgttttcagattttggacttgtaaaagctatcggtagctaaccaggtaatttggatgtttaagtgatttgtaataatcttaatcatttggtgacttggaaccaagggtggcatgttattccctacggctgccatagcaaagtagcacacactgggtggctaacaacccctgaagtgtattctctcacagttctggagcccgaaggctgaaatcaacgtgttggatgtaggggagattccttccctgtcccttccagcttccggtgactccaagtcctccttcgtctgtggctgcatctctccagtgtctgcctctgtcttcacaaagctttttcatcttctctgtgttcccccatcttctgtctctatgaaaacacctgttgttggattgagggctcacccgagtaatccaggatgatcttctcatctcgagttccttaacttcatcatatctgcaaagaccctttcctaagtaaagccacattcacagatgctgggggttaggacttagatgtacgcttttaggggccaccactcagcgactacagatggtcacagattttttttttttcagaatcactatttattgagtgttgtttataatgtgctcaagtggttgctggagagagagggactgtggtaaaatgagagtgacacctttgggttggacggtcccaggcttgatttcaggctctagcgttctcccagctctgggagctgggatgtgcttcttaacttctccgcgtcccagtttcctcatctgcaagatgacataatggcgaagttatgtaaagttcctaaaaattctgaccagtgtgatagatacatcaggagtgatcatagttatggtgttttcttatttaaagatagcatttttttcttttaatggaatctcgctctgtcgctcaggctggagtgcaatggcacgatctcagctcactgcagcctccgcctcccgggttcaagtgattcttctgcctcagcctcctgagtactggaattacaggcgtccgccaccacacccagctaagttttgtatttttagtagattcggggtttcgccatgctggacaggccggcctcgaactcctgacctcaggtgattcacctgccttgacctcccaaagtgctgggattacaggcgtgagccaccgagcccggccagtatttttatcatttctgaaatcaagacgcccgggttccctgatgttgattcatggtatctttcgtgcctcacgaatttttccacaaaactgctagggcaaaagaaacacctagttgttctggttactcattagtgagacccaaacgactaagcaggtgtttatgtcctagcaacttcgtagcaatatgaaaagtgttattttattcttaaataagcccggttactccggggatgtgtgtacatgctgaaaactgcagaacttctcaaacgtgggaattacctggggcatggccacccctcttcctgctccacactgatttttgcacaatcctgctttttatcttggcaaccacgagaaaaccagcttcacaaagatgttgtcatcaaagggaacacagcacggtctaatttgaaactcgaagataagccaagttgattgatcacttgatgtttgacagaggtcaagtattattttctaatttggttgtataaaatttaccccctaatcagcaggatttgaaagcctgacttcctttttctttaaaaacttcctggtcctaattgtactaaatattttatgtatgatagtttattctaaacctactgtttcttctacatttgcaacctctttattttactattttaaagttttattttacaattacagcataaaataattgtccaataaatatttgttgatgaataccgtgtcaaataaaccacttttcattcaggctgccacgaaaatgaaacattcaggagagacaaagcttgctgtaacatgtggtttagatctgtggtgtggccaaccgaccactttttatgaaacaagctcagatctagcttcttttatgtgcaccaaagataaggatgatgaagttagtaaaaacacattaggtcatatttagtttatcttttcaagaaccaaatcagttactcctaagatgagtagactgaattatggattccatgtgctgatggagcctttgagtcgtatgtatttgttcataatattcattcttactcatccttttggttctcctactcttcagttctttcattcattcaaaaaatattttgtggccaggcacggtggctcacacctgtaatcccagcactttgggaggccaaggtgggcagatcacctgaggtcaggagtttgagaccagtctgggtaacatggcaaaactccgtctctactaaaaatacaaaaattagccaggcgtggtggtgggtgcctgtaatcccagctacttgggaggctgaggcaggagaatcacttgaacacgggaggcagaggctgcagtgagctgagatcgcaccactgcactccagcctgggcaacagagcaagactctgtctcaaaaacaaatttcttgagcaccccaatattcatgcatggggtgggggttgtatacctaataagtatactgggggtatggcgatagacaacatggataccatgttatgtgcttaaagtacttaacacgtgcctggcacacagtcattagcaattggtagatggagctaatgttcatattattaagtttatgtgttgtgccttacaaagctccactagaagaaacacagagatgacgtataaatcaatatgttgtgaatattttattgtacactttggttatagagaatctgagattctctaggatgacagacaataatgattctcttattgacatttatcacttcatcatgcctggcaacctacgactcctctttagctattagagggcacatgtgttgaagggtctgtcctcaacccattaaaaagtatggatggtcctcaggggtatttagtacctcagaaggatttaaaactctcaaggattagtaagtaattagccttcatgcctgatgtgtaaacagcaaaggcatctttgattttggctcaatcaatgtaattttaatgttaacagctctgagatcagcagccaacagttaaataaactttgacactgagagcagacatttcagcagaggtacaatccaatttactgttgattgatcaaccagcttatttcctttgactttagacatttgtaaattatcttacaaatttgtaaattatcttacacatttgcattatatatatatatatgtgccaggcttctaggttttttttttttttttttagacaaaaccaaggttaaaaaaaacaaaaacaaaacttggatgaacactcatgactcaccacatgggaccagacttctggttgttggatctgggtttcatctggtactgagggatcactaagaggcttctgattctcctgagctcatccccatttcattttcataatctgtatacaaaaacctgtagtcctccagctcttccttaattatattcttccttttcttaaaaaaaaagtcattccatattgcataatttatatttgtaaactgactttttaggcactccaaaaagagatagaagagctcttgtttgtaaaatatgggctaactactgtttcagcttgagaaaacaaatggcagacaggaactgcaaatctggtatagggtcctaggagaatggaggcaggccatatttataaagattttctatatcatgtgctttaaaaaaaaacttttttaatggtttgaaaccaattcttacggctctgaaataagaagtctttattactgtcttgtcagatgttttcattttgtaaagtaaatggcttttgattttgtattgctacataatcatttcttatcagttcatctaattgctggggctttgaattccaactctggcagtggtgagtttcaacttttctggaagactgtttgaatctgggatacagtcagctttcagaatggcaatagaaaagaaaccttgagattcctaactttaaaagatttattaattcagataaaagtttaggctggaagagaacactgacataattaaatatatttagtcatttaattctcattaattttggggataggatattatgggacagtgaccgtgtgtttgcaacttggcaatccaggaatactctcttctggtagctagttgcccagtgaataaacttaactaaagcagagaattatttgttaaaaatctaaaatactttattttaacagaaaacacctttttcatgtagaggcaaggactatgaatttgcatagtttttctagaataaatcatacctattatgtatccagatgtatgatttccagtttcattttccacagagaaacaaaaatgagttaattcttgaagctgagtgataggtatgtggaggttttaggatactgttctgctaactgttgaatgtatttggaactttccattttaaaatgttttttaaataaaatatagagaaataaagtgatcaagaatttcaaacgtacgagaagaaatagaagtgcagaatcattcttgagttttatgatttaaaaaagaaatctcaggccaaggcaggcaaatcacgaggtcaggagttcgagaccagcctggccaatacagtgaaaccccgtctctactaaaaatacaaaaactagctgggcgtggtggcgtgcgcctgtagtcccagctacgcgggaggctgaggcagaagaattgcttgaatccgggaggcggaggttgcagttggctgagatcgtgccactgccctccagcctggacgacagagcaagactctgtctcaaagaaaaaaagaaaaacccccaaaaaacaaaaaagaaatctccccaggggatgccactctgctgtagccaccactgagcactgtgctaggtgctgtggattcaaagatgtctcaaagtcagtcctgctctggagaaacccatggctcagtacagaagacagacagacaaatgcaagagaatacattctggttgcataaatgttctgagtgtagatagagagaagagaactaattcttcctaggaagttggggacacttcacagagtagctgacaatgtaagtcagggtaaaatagtagttacttatctgttcatcccttttgctaagtgagtgtcttggccctgcggggcttaattaaagccagggctgccctactcctccatgtcctgggaaacatgtcttacttttagcaccactgcttaactggaatagttcacgtggtgctgatatgtgagtcttccagactcaggtgcataatacactcaaatactacattaagaccctgtcattgctcatcagatatttactgagcatgcatttaaaatatatgggtgagagctgggcatggtggctcacgcctgtaatcccagcactttgggaggccaaggtgggtggatcatgaggtcaagagttcgagacctgcctggccaacatgctgaaaccccatctttactaaagctacaaaagttagtcaagcgtggtggcgcatgcctgtaatcccagctacttgggaggctgagccaggagaattgctggagcccaggaggcggaggttgcagtgagccaagatcacaccactgcaccccagcctaggtgacagagactccatctctaaataaaatgaaataaaataaaatggtgagaaagtcatttaagtataaattctttatttgcctttgagcacctcaatatgacaactagtaaagaatgtttggataatttatttatttggcaaatatgaggcttctgtattataagcctatcttttactcattcaacaaattttatctaatgtctaccatgtctagggcacatcagcaaaaaagacacagcttacagaatgatacacaatataacaccatttattgaagtcttttattatgcatgtaaaaataccaaatattgttgtgcattcatttatatatgtaaaagtgtttaaatgtcctgggagaattgatggtcaagttcaaaagagtgcctctgggtatggagtctgtgagtgtatcaccttaccttcaaggtttcattcttttctgtaggaaagattaggacaaaatttcatcaattgtcagttttaggtggtggcaaggcaggtatgtattttacacatctttgagctctttggtattttaaaaatttctccaaaaagggaacgtaggagaatttcagttgcagaattcgggggttggaagtggaagagacacaggaaaaatctgattttaacatgagggtacacagcggagagagagagggtcgtgacagtatacccattccttggtgagagagcaaaagcaaagtgacttaattgattatttattgattagaatgatttaatgagctttctaatcataagtaattttgtttttagattttatagatcatttctagattgcatctgtattttgagcaaaagttagttgtgctcaagatggttttgctgggtacaggttactatgaatgcctgtaggcctgcatttaaaaattaggaacccgtagcagttctacgcagaaaaagaaaaagttctgtgaaaacaaagcaggttccatttgttgagggattacgaatgttgcaaagggctgaggaaatccgtttaccgtgggtacagcaaagttgtttcccatcgttgagcacaccacgaaagaagactgattcaggttctaagacgctgggaaatgctctcttgtcctcagtcggtgtgttcttttaccttcagtttgttttgctgggatacatcatttcctctctccttgcgaagggctgtagccatcgtatcctcctttagaatatatttctttaagctctttagaaaacttcagtcatgaaatgcttaatgttctaaatctgaataaaaccattgtgaatgtagtccgtagctcccttgggactacagtttctaaagggaacaatttaacatattttctatgtcaatgggcacacagggtaaatgattttggaaagaaagcaataatgtttcctaggtctaacaggtcttgttctaaaacaaataaatacgagacgtcggctgaattcagggtcacactttttaattcagatgacctctcagtgtttaataaaatggcaggatagcatcatggttaaaatgatgggctttctaggaagactgacttcatttcaagcgtttatttgctgtgcgacttcaggcaaattacatgccttttcttagtctcagtttcctcactcgcacagtgactgttgtcaggaggattaaatgagcttatgtctgtgacaagagctaagcacacagcaagaacttaataataagtacagtcatgcctcggtgtccatgaggagggggggttgggcctatgaccccatggataccaaaatctgaggatgctcaagttcctagtataaaatgtcctccatatctgtgggttctgcatccttggactcagctaactgtggatcaaaaatatttggaaaaaaaggcgttcgtgctgaacacatatggactttttttcttgttgttattccctaaataacgtaacaactatttacatagttgtggttttttttttttttttgtgatggagtctcgctctgtcgcacaggctagactgcagtggtatgatctcaactcactgcaacctccgcctcccagcttcaagcaattctcctgcttcaccctcctgagtagctgggattacaggtgcgtgccaccacatccagctaatttttgcatttttagtagagttgggggtttcaccatgttggtcaggctggtctcgaactcctgaccttgtgatccaccccctccttggcctcccagagtgctgggattacaggtgtgagccactgtgccctgcctacaactatttacatagtatttacgttgtattatgtcttgtaagtaatctaaagatgatttaaaatatatgtaggatgtgggtaagttctatgcaaacaccacaccactttacatcaaaggtctggaccatccgtggatttcggtatcctggtggggggtggggcaagggggctcctggaaccagctccctaagacagcaagaaataactgtatttgcagtgaactcttgcacatcctcctgtatactttaaattaattctacatgtgcttataatacctcatacagtgtaaatgctctgtgagtagtcattatactgtatttttaaaatttctattattttttgcttaatcgttagttttgattatttttttccgcatagttttgatcgttggttggctggatatggagctcgcagagggctgagtgtaatatttcgttgttggccttggcattctctgctttattagccatctagtttgtggggtggggctgtcctttgcttctcaggcaatacacatctcaaaatatgccctgttgcattggccctttggttctacacagaactccacttttccactagctatatacattatttaatttctttgtgcttctgtttccctagctggaaaaagcaaatcatagtagcactacatcattgccttgctgggaggattaactaaagtaatggttgccttattgctcagtcctcaataaatgttcactctgtgttttgtgttccagaggctgtttcctctgcctggaacacacctccccttcctccttcctgaagactccttccttgtcatcttctctgttgtgtttgtcagggttctcccaagcagagtggaacggtgcctcctctgtgtctcaatacaattttgtacatactaatattactgcagttagcatgtgttagaaccagttggctttttgcttgatgctgtgctatcctaagttgttacaacaaggctccatggtagcaaacttacatttaagagtaagtagaggctgggtgcagtggctcacacctgtaatcctagcactttgggaagctgaggtgggcagatcacctgaggccaggagttcaagaccagcctggccaacatggtgaaaccctgtctctactaaaaatacaaaaagttagctggtcgtggtggctcacgcctgtaatcccagctagtcaggaggctgaggcaggtaaaccacttgaacctggcaggtggaggttgcagtgagccgagatcatgacattgcactccagcctgggcaacaagagcaaaactccatctcaaaaaaaaaaaaaaaaaaaaaaaaaacacgaaaaagagtaagtagagatgtttgacaagtatgtggaggcttatttcctttcaaaaagaagaagccaatagagaatcaatttttaggttgcgcatttattatttgtccttaaactgatacatagcatcttaaaattggcaggtggaatgttttccagtagctccatatttctattagtcaattcaacacctagtttggggaataatcaccaggcagggatccaggtgctcttggggctctttctctaatatgcagcctttggacaagctgttaacttgttaatgccttatccttttttttttttttttttttttgagacagagtttaggctggagtgcagtggcgcgatcttggctcactgcaacctctgcctcccgggttcaagcgattctcctgcctcagcctaccaagtagctgggattacaggcacccaccaccacacctggctaatttttgtacttttagtagagatgggctttcagcatgttagtcaggctggtctcaaactcgtgacctcaggtgattcacccgcctcagcctcccaaagtgctgggattacaggcgtgagccactgtgccgggctgccttattcttaaaatcgcaataatgagacctcacttaccaggttgctattatgattaagtgagagaacatgtgaagtattgtctctgatacttagagggtgctcggcaaatcttagatctttctttctcttggctgtaatctatccattgctgaaacaaggatgctaattcctggagactataagaaaaataataagtgatatccactaagcagaggtccacacagtagtggcattaatagttttcatattttttttttagtcttctcatggagaaattgaagctattggtataataggtggggaaagcagtgttcacaaccactaatcaaacgaagattaggcactaaatgaagaggaagaaacaataagagaggagatctcagaaatgatctcaagttgtaaacactcaggagccaaattacaaaacaaatacacaggctaattttaaatcaatcactgtattaattctttaaacatggaaattcaaaggtagcattttttctctttttgtctttgattttaagaaactgcccttaaaatagtaatagtttggatgtgtaatttgctgtactttcttaatttaggccaggcgtggtggctcatgcctgtaatcccagcacttagggaggccgaggtgggcggattacaaggtcaggagttcgagaccagcctggccaacatgatgaaaccccatctctactaaaaatacaaaaattagctgggcgtggtggcaggtgcctgtaatcccagctactcaggaggctgaggcaggagaatcgcttgaacccgggagatgtaggttgcagtgagcccagatcgtgccattgtactccagcctgggcgacagggcgagactccgtatcaaaatcaaacaaacaaacaaaaactttcttaatttaaataccaatacactttagatttttgcaagatatttttatatttttagatcatatttttttgagtgcttgttgtttcaggctggtggtcttatccgtttagacatttagccaagtcatgcttcccatttttctgctttgatgtgtggatgctccattctctcggcatttgtatccctcctctagcaatgtcacctcttccccacttttctcacaatgtccccctgaggtttgagggttcctactgacagttaacaccatgaattaaaagtcataaagttttcattttaggcatgttcttctcactattgtacagcatttttattgatttgctaactgcattggattaatctgctaactgcattacactcttattaaattacattgctattccagagaagggacagctaaagctgaaatcctttagtttttatttctcttggtagattaagacactttggtcattcattcattgattcatatattcagcacatgttcacagacgcttattgtgtgcctgggtgtggtctaggtgtgggggattatccaaggatatcgggtagtgagcaaagttgaaatggtctccgccttcatggacctacagattagtgggagagagagagagagacagactcagactcaaacatgaaggaaataaaacaggctgctaggaggttcagaagaaggggacctggcctgggcaggatgctcctggggcagggagtgtgaaggccaagggcagcagaaagtaatggggagccagtgtggctggagctcctgggcagatcaggagagacaggatggaaagaagagacagtgccccaggaagccactggaaggcttaatgggggaagtggcatgggcaggccgagtttgtcaaagatcactgtaccgaggggctggaatgacatggagcaggatggttgggcatgcaatagcgcatgaggccggggagccacagaactcacagcctgctggggactccagacaaggaaaagagcagcctcgctgcagccagagaacagcttgcagagagcctgcagggggctgatttcaggagctcacagttttgtgggaacgcaggctggtaggagggagcagctgccaagagatggagttagggatgttcactggggtcagagcagaaagcccccacaacccacgtcatgaagtccctagtttgtttaagaaggacagtagtgcggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatgggtgaacccgggaggtggagcttgcagtgagccgagatcgcgccactgcactccagcctgggcgacagagcgagactccgtctcaaaaaaaaagaaaaaaaaaaaaaagacagtagtgcaaaggctttgctcagcagtgacaggatcaccttgaggcactttaggagctcattcttcctgcagtgtggagaaaggatttgggatgacagaggtgggaagaggagcaagactagagagaggaagggaagtccatgttgctgcctgttcatagatattttcatccatgatttagaggacgacagtctctctctctctttttttttttttttttttttttgggacggagcttcgttcttgttgcccaggctggagtgcagtggcgcgatctcagctcactgaaacctccacctcccgggtacaagcgattctcccgcctcagtctctcaagcagctgggattacaggcgtgagccgctgcgctcggcaaggaagacagtctcttatccagttttctaaaagtaggtgagtggtcgggtgcggtggctcacgcctgtaatcccagcactttgggaagccaaggcaggcagatcacaaggtcaggagttcgagaccagcctgggcaacatggtgaaacccccgtctctactcaaaaaatacaaaaaaattagctgggcgtggtggtgcatgcctgtagttccagctactcaggaggctgaggcaggagaatctcttgaacccaggagacagaaggttgcagtgagccgagatagcaccactgcactctggcctgggtgacagagcaagactctgtctctaaataaataaataaaaagtgggtgagcgactctcttcactctccgatgctctctccctctagccttttgtagtttccccacattaaagtggttttgtttgcggtgagataaacaacaccggacttccacactctctttcttggaaaacttcggcacagaaagaatgtatttgtgagttttctcaaaaggcaagagaagcaagtgaatataaaatgatcccagtcatgcatatttcaaaacagggaaactgctgcagaacccacatgctactttttttatggtgttggtttgttctgcgtactttgaaaaccgtaacacatctcatttcacaaattatccaggattcatatactattcttctaaagaaaaaagaaaagaatccatcactgattttacttttgttctaaaaatgttattgaaaccttttcttcattctgaattatttgaactcaactatgtgattcttgtcggaagtatatacagatctcacaaatatatttagattcctttccacaagagtagtttagttaggggagtttcctattaaataatattttcattgtaaacatttgagactttaaaaattgtccaaataattgggggtaaatcaaaaaggaatttgaaaagctatgaaatagaaagaacagaataaaaatttctccatcttgacagccttaaaatcagtggcagtgactgccagaatgtgattgtggagcaccaattttgtgatacttgggcctcttgagtaaaaaaagaggtgcatgtcacattagtttgggaaatgctgaattaaacaaagttgcaccattttctttactgtaggactccttagggtcctacatatgctcatgagtggtgactataccaacgcaggtataaagtgtggtgtttccccatggaatactatgcagccataaaaaaggatgagttcatgtcctttggagggacatggatgaagctggaaaccatctttctcagcaaactaacacaagaacagaaaaccaaacaccacatgttctcactcataagtgggagctgaacaatgagaacacatggacacagggaggggagcatcacacactggggcctgtcagagggtgggaggctgggggagggatagcattaggagaaatacctaatgtagatgatggattgatgggtgcagcaaaccaccgtggcacatgtatacctatgtaacaaacctgcatgttctgcacatgtaccccagaacttaaagtataattttaaaaaaaaaagtgtggtgtttcccagatggattttaccacaaaactttttttttaaagaagtgtattctgggactagtgttttatgggatttccttgggaaaggcagatttttcacacaggggtggtatatgggtcatgaaggcaagggtggtattgggagcatacctcctagccccacacctggttgcccctttaccactttgcattgtcattcattgccaccttcccctcccactagaggtcctggaggcaggggtgccccttgttcctgttgtacccagtggcaagactggggcccattcatagtaggtagcacttaacttgcttgagcattttttctgtgccacacactatttatgaggtatacatgattattatccctgattttttttgagactgagtctggcttaatcgcccagcctggagtgcagtggcaggatctgggctcactgcaacctccgcctcccgagttcaaacaattctcctgcctcagcctcccgagtagctgggattacaggcgtgcaccaccatgcccagctaatttttgtctttttagtagagacgggatttcaccatgttgcccaggctggtcttgaactcctgacctcaagtgatccacctgcctcagcctcccaaagtgctgggattatgggcatgagccaccacactcgaccttacacccattttatagacattaggaggttcaaaacttgcccagagtcctacagctggtgtgtgagggagccggaaagtggttctgaatagatgtatgcgacatgagtgagtgaaatttgctttactcttgcagagctaagactgtgggcctctaattctcattgaaggtggtttcatgtgacaacaccccttccgtcgtcattcgggtaaatttctttagtccttgataaaaactaatttttgtaattaatgcttctttaaaaataacatgaaaaaagaaactaaaagaacatccactgcaccgtggagcacttcttgtcacgttgcagggcccgtgggaggaactcaaaaaggtctcactggcggattgatttctgccctaccaagcctgtgctattcattagggtttttttgttttttgtttttgtttttgtttttttgagatggagtctcactctgtcacccaggctggagtgcagtggcatgatcttggctcgctgcaacctccgcttcccaggttcaagcgattctcttgcctcggactcctgagtagctgggattacaggcgcccaccaccatacctggctaattttttgtatttttagtagagacggggtttcaccatgttggccaggctagtctcgaactcctgacctagtgatccaccctcctcggcctcccaaagtgctgggattacaggcttgagccaccacgccaagcccgcttttgtttttataattaatttttacttttacaaaggtaattatttacataatttaagaagtcaaaaatgcacacacacatcacacacactactgtctagcataatgaaaaataacaattgcctgatcgcttccccaccaatatttatttatttatttatgtatttagagacagagtctcactgtgttgcccaggccgcagtgcagtggtgcgatctcggctcagtgcaacctctgcctgcctggttcaagtgattctcctgcctcagcctcccaagtagctgggattacaggcgtgcaccaccacacccagctgatttttgtatttttagtagagacggagtttcaccatgttggccagactggcctcccaaagtgctgggattacaggcttgaactaccacgcccggccccccaaccaatcctggattctcattctcagaggtaatctcttcagactcctctagttgtttccttggcatgtatctaatttctaaatgtgcttgtaatgctttatcttggtttattactttggattttatcttttctcttcctggtagcctaagggaaatttagcttccttatgtactcacctcacctccctttatcttccgcatgtacaagaacttacagataaatcaataatcagtattggtattaatgatgactacataacttttattctttgaagggccaagtattgtgctatgaatacacttactttccttacacagccattcgttttgtctgcagttaatgattgcctttttaaaaaattgcatagattttaaaaaatagcctttaactttttccccagtgctcatcagaagtgccagattcccaccagaatttttttccccaagtactctagtatctcaggcaatctaggtattcctccctgttcttggagacttagctttgagagcgccctgtcctcctcctctgatcgggactagtagcttttaaggctggctaacagctgatatctgggagttttcttttcaccattcctgtgttggatcctctgtcttctaggccccatgtcttcctgttcctggatttatttcccgattttgctgggccacatctctagtagcttcctgggaatattaattttgggagtttgggagaggattgttctgttctgtgccttgcatccgcttctttaaagtttttttttttctagtttttgctttgttttgatctctggaggcactaaagtgttgcttggaagttctgtgggaggtgggcttatccctcgtgggcctgcctgcagagcgatctgtagaggataatggttgggcttttctcttgcgccagtttccctggaagagtctaccaggctccagagtgtgacagcagtccagagggagagtaaggcatatgatttttcacataaccctatttcattcagtaactgatttctcctttcagctatgcttggtatccctaagttaacaacctgtgggttaacctctccagtatataaaattgctgccgtctgcctaggttgagaggtaactgtattagatgaaggaataggactgagtgtctaaatgctccttagaaagttttgcaaacaatagttctgctttcagtcctgttttacacctcgccgttaacaatacctgaatttgagagactttgcagccttctttcctcccaccagcttttaatttatttcttgtgacagaaaagttacaaagtacatgaaaggaacactagtctgctattcacctagatttactaattgttaacattttgctgcatttgttctatctatctatctatctatctatctatctatctatctatctatcacctatctgtcgatctatcattctatcattcatctatctatctatctatctatctatctatctatctatctatctctagtatctattttctgtacatttgagagtagttgcaagcatcatggcactaatgttttagagctgcatttcctaaatgtttcagaggtacatttcccaagagcaaggacattctcttacacataataagactagaattactgaattcagaaagttgatcattgatatgatactatttctagtgtgcagttaacattcacgttttttctgttgtcccaataatatcgtctataactgttttttaaaattcttatatttaaattccaaactctaaggatcacatgttatattgacttgcatttcttcagcttcttttaatgtcagagttttccaacctccttttgcattttatgaaactgattttttcgagcattacaggccaattgttttgcagaatattcctcagtttgaagtccaattatttctccatggttagatttagattaagcatttttttgcaagaatactgtgtaagttgtgtggtgttctggacacaggaaggggaacatcacacagtgttgtggggtgggggtggggggagggatagcattaggagatatacctaatgtaaatgatgagttaatgggtgcagcacaccaacatggcacatgtatacatatgtaacaaacctgcatgttgtacacatgtaccctaaaacttaaagtataataataataataataataataataataataataaaagaaaaaacactgggaggcacgtggtggctttttgtctcattgatgatactaagtttgatcatttggttatggtggtggcagcctgatttctccattgtctttttctttttgtaattaaaaataatctgttgatattttgaggctgtatgaatagcttgttttccaacagcctttgaccctgtggttttatcatgcatcagtaattcttgctttaatcacttgttgcaatggtggttacaaatgtgatattcgaattcgatagtttcttctaaagttatgaattgatgttcatttgttgaacgaaaataagcactgtcctttctaagcactctataattttttgtttgtttttgtgccataatggactcatggatttctttttattcagtgggttatagtcttttgcaggcatggtattctatgctgaactggttcccgatttgaccacagaaatcctttcaatcttgtccccgtgtcttttgaggtgtcctcatcagtttttgagccttttctgacactaaatgatgttccatgttcacctatgtttttcctgccttggacctatttgtgatgatcaattatttctctaaggcaccgtggtttccttcagggcggatggtagaatggtatttagaacccaatatcgtgaataaggcaccctggtttctttcaggggggatgataaaatggtatttagaacccaagagagtgaataaggcaccctggtttctttcaggggggatggtagaatggtatttagaacccactatcgtgaatgaggcaccctggtttctttcaggggggatggtagaatggtatttagaacccaagatcgtgaatgaggcaccctggtttctttcaggggggatggtagaatggtatttacaacccaagatcgtgaataaggcaccctggtttctttcaggggggatggtagaatagtatttagaacccaagatcatgaataaggcaccctggtttctttcagggggaatggtagaatggtatttacaacccaagatcgtgaatgctatgggagctctttgtactggggtggcgttgcctcctgagcttttcagtggacggagctaggagaaatatacatataaaatcaggagttcatagagatatcactgggctctttgtctcctctcatgattaattttctcagtcacaccatatataccatatatataaaataccatatatataaaatagtaattttagaattactatacccataccaccctctgtggttggcttttcctcttgtatatatatttatactttcttcactcctgtaattcagctacttctcatccatctgcttttccaacttccaaaattatttcatgacttatctgctttcatcttccctctcattctcttctccttttctattccacctactgtcattttggtgagagttggggagacactgtttgcagtctgccatgtttaactgaaaagcccatcttagatcttccgtctgttggttacttgaagtaagaagacagagaataagcagtatttacctttaacaccccaagtagctctgctcatgatgtctgcctcggtgtcccgggcccgcactcctccagtatccctcactggcaattagaactctgtacggcttccttgaagtttctcttcctaactctctcagtgggtgggactccttttcagtgatattgacggtagacctgaaaattcagggatgtgggcagttctggagagaataggccaggctctctgtggatacatttgcactgtgcttgaggactgaatgctacaaatcagacagtcctggattatttcagactgaaaaaaattaggagactaacctgggaagaggcagaaggcacgccagctctctcagcatgtttttgatgtctcggtgttctcatttcattgaaattagtgcagacctctcccctcagctgtaacacttggattttctaagccactttgatgtctcctatctctgcttatttacaatgaacatagcttcgaattttcattttctttctactctgttaaatgtgttatgtggaaatctgaaatctgaagacaaatttttaccttagaattctaagaatgcctttggtatcaacgccagttaggaaggtctaactcagggcggaagggggggttttcaaaaaggtgatattcgtgaggcagccatcgccttcgaaacactttgagaggtttaatttatttctcatgctttggtaaacaaaagctggcattttctttccatggtttttccactgcaaggctgccgttcctccccttcccccgcagtggtgcattttggtgatcaaatctaaaacatgtgtcaggtttgcgggcatgctttttaccaggaacctcctttaatacttgccatattggcagttttcacaagatcttctcgctgtgctttatttatttatttatttactctgcttgcattgtggaattatgggtagagctgttttacatcagaatcatgttaaataaaaatattgaaagaacattttgaccaagaataatgtgaatatttcaacataaatatctatgctgaattggcttctagatttcagaacaggaagaacatcttcagtgatgttcatgatttggatttgctttgctgcggagtaggtttagcgacaaattccatctggctggagctacatgcagtctctctattgattggttatattgggacttcatgggagtgtccttcaatttgcttttcccagcatttttaaaagctccattggaaaaaaaaatagagactagaaaagaaaaaaggaacctgcattgtttcagtttgcatccaacatgcaaaacatagttctaaatttttaattagctaagtgagtggtgaaaaggaaaagtaatataacaagcctccgtgagcagctgggatgtgttgtcatgacgacaagttcagcaggctgccagcaagcatgtcaatgggtaatattgggagagcgctttgaaacagtgcctgctagccacaatgtgattggtcacgcctctgttgtctttgtgtgaaccggtgcatgctgggtaagacctagagtgaatgctcagcttgtctcaaggctgcaatgaggtaatgcttctgaatctttggggatcatgagctcctgcctccaaaagactgcagtctagagtgttttcattccgatttgcgttaattaccgactgtaacatgttaggaagttttacagctgcctttattcaatcttttatatgtgcatgtgtatattatagataacttaacacgtgtgtatgctgcatagagaatctcaagcgtattctaaaaaaagagataaccctccatattagtcattctgctcagagtcaacatttcatttgattgctggcatcagtgacaatatctattggtggataaatgatacattaaagtgcatttacattgggtaagcaaacttgttcatttctagaggatattttggcattgattactttttaaagccttttatctataatgagtcgtaagggccataaagggggatgtaaagagtgtcggatttgcttggtcaggaggtttagttcatttttagattccttgaaattggctggtttatatcctaatattgatattatagtctttcattaattgaccataatatctgattgctccaaaactatctgctgaataatgctctgacagtttcaacttaaagctgtaaagggaagctgtgtttacagacgcaaagatctggaaatgtttatggtggtttgtgaaacaaatacatcaaggtgctgatgtgacagagacacatgagctacacccctcagccctacccctggttctctgtgacacagcgacttggatgctctccagggttttgtcggttggttagagaatgttttatcacattcataaatagtaacccaatgccctggaaaggttaaggcagtgtctccaactaaggtatgtgtcgctaggggggacacataccatagttgagttgggctatctggttcatcgtgtcacaaatgggaagcatgtgagcaagcttttggacagagctcaccgagctgtcatattgccaccccaatgtatttacccctcaaacagttcataaaaatttataagcctttaaaagcataaacaaagaataaaaacacatcgaacgacaagtgatggttgctgctgctgctgctgctgctgctgctgcatagaacggtggactctgccagccaccttgctttatgtgaggtcaggccaccggcatgtgaggaagctggatgatcgtcagcccagctacctccgttcaccaaatacaaggccagctagcaagaatctgtagccagctttgcagcgcttcacccttgctttattcttttatatattcattttttaatgttttagattcagcggtacaagtgcagtacccctaaatcttattgtgttacatgcgtatcttccacagtggtgacgtctgggcttttagtgtgcccatcacccagatagtgtacactgtacccagtaggtagtattcttggcttatttctacccctctatatggtttccgtttatatggctttgtaaagaaagactttaccaaagatacataaatgtgatagcatagctaggtttttaaataattggttcaaaatatttgtagcacaaaaaggatcttgggttgtgacttttaccaagatgttgattctatctcctggcacaaatgccaaagccagacagcttgtgctgagaccacagttggagaggcctttgaagtgggctggagtcctttgtctaaaacaaagcagggtgcggtgaccccatgaagagaaatccacctgttgatgagacaggcactttttctctataaacatttgattgttctgttaccttcatttctctggcagatgggttaattgtgtagtttcaaatttcaaacatgcttttctaattaaacaatttttaggttcattaatgactcagtttgcataagattggatcctctgtagtgcagttccattgttataagcaggatttgttatctttgttgactcgcaggctgtaaagattcccttactttaaaatgtagaaatcacatttcttaatcgtcataggaagacaactttattttgtgtaactatatagtaatcgtttttcttaagtggcaaaattctaatcttttatatttaggtgatttagtatgtctctgtggtcagattatgatatggcaaaatcttcattattaagtcattttaaagcatctaacaaatgcaaaattaatacgttaaagattaagtagaagtgaaaggtaaagtgatgttctgtttaatttactatttcatgagctttttactattttgaaagcccccttgaagaggagcaatggcaagttcaaactagcgtgaatcattatatcctgtgacaggttccacaataaatgacttgtgattgatgtgaagcctgatgcttagagattaatggcagatgcagtattgtagtgtttttctttcatcactaatattatccagtgaagctagtagcttagcaaaagactttgctcagaaataattgggattggtaatactgatggtctgtgaagttttaaaaaatatgaccctttagggaagtctagagaaaaacagtgtgcttttagataatttggtgggttcaagaaatttaaaaatacttttctttagaaattcactgtttacaaacaaatatcaagctcactacatttataaaaggggggttattaagcagtagaagcaaaagttcttttgaagataggcaaactttaggagaagaataaaatcagggtctctggaaggtagaatatcaagagtattaaggcttcaaaatcagacaaaatcttaattcttctacactcattggggtaacttttgatcacttactctctctacattgatccttctcccacactcaccagtcacaaaagtcagtgtcccccaggtgtagatgagtgggatggaccagtggatacacctggctctttactgatcaggtggttctgtcacatggaaatatgaggagacagtatttgttacccccaactaagaaacatgtggtctctattcttatgggttttattatgacgtcaaaaagtcatatttgtataatacttaacttcattaataaagtgccattaaaataatttttaaatgacacaaattataataggaaacaacatgttgaatgttgcttttatctatttaaaaatgttatattttttttctttttttcttttttttttgagacggagtcttgcactgtcacccaggctggagtgcaatggtgtgatctctgctcactgtaaactctgcctcctgggttcaaacgattctcatgcctcagcctcctgagtagctgggattataggtgcccgccaccacacccggctaatttttgtattttagtagagacggggtttcaccatgttggccaggctggtttcgaactcctgacctcaggtgatccgcctgcctcggcctcccaaagtgctgggattacaggcgtgagccaccacacccggcctaaaaatgttgtattatttctaatatgacaaaaatgcaaccttactggctttctttttttttttttttgagacggagtctcgctctgtcacccaggctggagtgcagtggcatgatctcggctcactgcaagctccgcctcccgggttcatgccattctcctgcctcagcctccctagtagctgggactacaggcgcccaccaccacgcccggcttattttttgtatttttagtagagacggggtttcactgtgttagccaggatggtctcgatctcctgacctcgtcatctgccttcctcggcctcccaaagtgctgggattacaggcgtgagccaccgcgcccagctttctttacaaagctgaatgttgataattgaaatagagactagtctgaaatgtacttctgttccacttgtgtaaaaagggtttcctaaatgaattaatggcacaagggagatgatctgcttcagagaataaactttgcaagtcacttcagttcttccgatggggtgctgattaatattcaaatgttatgttgagaaaggactgattttcagatctttgtgacctagaatcacttcccctatggtgcattttacacattgtgtggttgtagtatgtcaaatccttttttatttggagctcatgttatttagattgagtctatggtgaggttgtatgtaatgcatgatgccaacagcgctgggagagaaatgctgtctttatctcagtacctgtttatcttgagttgaaagtttgttacttgtaggtggattgtactctgtactgtgcttttgtcttccttttgtccccagaccagagctaagtataaaacaggtgtaaaaaattggtgagtcgtttttgttttgttttgctttttgagacagagtgttgctccgtcgcacccagcagtggtgcagtctcggctcactgcaacccccgcctcccaggttcaagcgattctcccacctcaggctcccaagtagctgggattacaggtgcatgccaccatgcccagctgattttttgtatttttagtagagatggggtttcaccatattggccaggctggtctcaaactcccgaccctaggtgattcacccgccttggcctcccaaaatgctgggattacaggcatgagccactgtgcccagccaaattggtgagtttttacattgaaacgttatgaaaaattacccttgacctcagaaacaggaaatggaagggttttatgaaatcttagacatgttatctgttgaattttcttatcacgaaacagtgctgctcatatttacccatttcctctttcaatcagcataaaaatcttatagtcttgaaatctgaaatttgaattaaaaagatattgtggttgaatttaaatcaaagcagttatgccgtgtttatgaatcttttagccactcatggcaccagcatgtccgttttcttggtgacaaggcatgtggaatggtgacaagtgtgtaggttcaggatattagaacgacatttgaatcctggaggtaccatttccttgctgggagacttagaacaaattagctttaatcctttaaatgaggattacacccacatcacaggttatattaattgtgaacctatatgaagtgtctgacatagagtactggccgtgcagaaggtgtgcaataaatgttagcattctttatctcctgcttgcatttaattgctaaaatgaccaaattctgttcactttaatgggatatctttcctgaagggataagataaaattgtttgttcttcaactctgataagttattctagaagaatatctttctgataccattagacagttttatcatctgtccttatgtaatgtccttagttttatcagctcaaaaatagggatgcaattgatatcaacatattgagatcattaggggtttatcattggaaaaggggtaagagaggagctttagacgggaagctcattcgggcacttatgcttagggtgacagaggaaaccagtggcgggggttgtggggggcggtttccagtagtgcaggtgaaaacctaaagcaaaagaaaggaacggatttagagacatccagagagtgagtagagtggctctgttgactgtttcattatgagggaagggggtggttagggaagaagggacagcaggtgtctgtctcacattcatgtgtcatgtggctgccccagtggtggtgctacagtccaaaccaggagatacaagaaggggcaggatttatgggatagagtgaacattcagttttggacatgttgagtttgaggcactgggggtatctaggtggaatcatctgataggtaaagagagaggggggcagggagggagggagagggagagattgagaaagacaggtgggtcaggcaatcagagagagttttgggaccagggagggagttttgaccccttcagctctatatggccaagagtggttatgcctgagacggtgggtgggcctgcccctgtggggcacatagctggggaagagaggaggtgtgggtgaggatggagccttcgagagctctcttttagacgccagcagaggaaacagttataagaagaggaaactcagaccatagttatgaatttagaatctgcatttggttttaataatttacacacagtgagtttcccaaagagatggagaagtcaactgtttggaaccaaaaagccaaagctggaaagaaccacagtgccctgagtcagttctgcatttgatggacagatggacgggtctcttgagtccactgaatttccatttcatcacagtcaccctcccggcggcgcctcccccagaagccgttcccaggggtggtgatgactcaggctacgccacacattcaccttaaccttcatgagaccacaatgctgcagatggctgtgggaaatagaaggtactgaacactcaacaaggaggcgtgcaatttagagtagttttcactcatctttagcatgagtgcttaaatggttgtaattagaagggatgacctaggacctgtgcggaaagtgtgacttaatattttaagtatttttgggagctattaaaacaagaaaagtgttctttactttgtcaaattttgcttttttcttttccttgatagaactcgatcaatgtcttagctattatataatctgtcattaaaactgtgaccttgggcaagttacctaactctccctgatttcattcatgaaatggagataatagtatttgtttcataaggttcttatgagaacaaagtgacgtgacatgtagaaagcccctttgtacatattggcagtaaagtgtagttgttatgagtaggaggtgggaagggtaggcattagaagtgagaggggctgggcacggtggctcacgcctgtaatcccagcactttgggaggccgaggtgggcggatcacctgaggtcgggagttcaagaccagcccgaccaacacggagaaactccatctctactaaaaatacaaaattagccgggtgtggtggtgcatgcctgtaatcccagctactcgggaggctgagtgaggcaggagaattgcctgaacccgggaggcggaggttgcagtgagccgagattgtgccattgcactccagcctgggcaacaagagcgaaactccgtctcaagagaaaaaaaaaaaaaaagaagtgagaggaaagcggttaaagatgatggggtgtgcatatgagtgagaatgtttatcatcgagaaagtgagtggtgcaagaggaagaaaggggaacatgatggtgtttggtgtctttaaggaagagtgaaggaagggtaagaaggcacgggagcatacactggccacccatgggtggtgctcacacctggcagttggatgtttgggaccggagatgtacctaacttagataacttgttgtgtgctctacgctctagttgttttgttcgggtttcctgcaatcagacatagctggattgtaggatgtcatgaaaatggtgatagtaggaaggaaagtagttataatcctgtgttggattaaaaagatcatcaactttgggttatgaaaaatgtagtgccacgaaagtatgaaaatgttaaaacttagaaacataaaataacagtttatgaatgcaaagcttgggaaatgaattatgaaagtctactatgtttttaggagcataagacaaaatgaggaagacaaaacttaaggaaaacccatgaggggatccagctgaacaccggatcggtacacactaagaaaataactgaaactcatgtgagttcaaacgcaagtgttaatgctttttatcaagcaaaagatatcaggatgggtaacactttgcttcccaaactctgaacatcacaaagggagttggggaatggcctcaggatgtgtgttaggattatcaatccctgtgcccttttccctcccatctttctgaaatctaatccaagggttgtcacacttttggacttcacgttcaaagaacacttcaataaaatttgtgtggatcaccataggtcgccagcttttagttctggcaagcaagtgctttttaaaaaaatctgtcatctcttatcaccattactgcattaaaaaagaagacatttaacatgcacacatgcatatacctacacacacacacacacacacacacacacacacacacaaagaagagcataattaaagacaattttttgatcaagtaaagttatctttatgagaaattttctttgttgtcttatcttttcttcttttcattgtggactgttaaaataattgtccacacaagcacaaacacagacctacagaatctggccagaatttactaagtactggtccagctgttgtctacctgctcccaggtgaccagcccaggacagcttgggagacagaaatcctgccaccttcgctgctacaaacgcagggctgaaaagaccaaccctttttccggaccactttgtggcccaagccaagttatcaaaaggatctttgttgccaggggatgtttttttcttttctgagagtaggttgggttgcggcaggggggcggggggtgttgggtggcaggggtttggccgggggaggggagggtggatagaaaggatagaaggtaaatggtataacacaagagggaaattttaaagactttcaatgattaagtacatatgacttcctttttcttttttgccctggcactgcctgaaaagtacatatgactttaagctgtataggcgagaatattttagattctagtgtaaagtaataggatacggtatcacattgggagtgatgtctttcttcatcaattgtttgttcttaaaacaagccttttatgaggtgtggaactttaaagaggccagttttgctgttcctgtgagaattgacgcctttattgcaaaatatgaatgtggtagacatgtgggtttttgaaagttaacagaaaaatctactaatctgaatagatcattaagaatgtagtctgcttcatcagtgtacgtgttacatgaacagacattaagagcttgtgacggcagtgacttaccagcaaggatgggataaaagtaaaatgtggaaggaagaaaatgcagcatggttttttattatagaagagcttacagacaacttgtattgatagctttcgcaaatttagaattaatttatattaacagtttgatatttggaaacatttacttttaaaaattagcctgatttgtatttaaaattattttttaaaatacagcaacacggtttgctttgttgcccaagctgctcttgaactcccgggctcaagccaccctcccgcctcagcctcccaaagccctgagattataggtgtgagctaccataccccgctagatttctgcttattcataatctatgaactttgaacttaccattttcagggttgcagggttttttttttgagacgggatcttactgtgtcacccaagctggagtgcagtggtggcaatcatagctgactgcaaccttcaactcctgggctcaagtcatccctccacctcagcctcctgagtagctggggctccaggcacgcaccaccacgcctggctaatttttgaaagttttctgtagagatgggatctcactatattgctcaggctagccttgaattcctggactcaagagatcctctcacctcaatctcccaaagtgctgagattccaggcgtgagccaccacaccctgccatggttgcaggttttaggtgttaaatttacatatcttgtgttggggaaactattgatttaggaccacagatctgaacaaagtataaaggagctgatccatcagccattcattcctgtctcaatagagactgtgccgcagtgctcttggcccatgcatgaaaaaaacactttatactgtcttgctaggtttctcaatctcagtctataactacatgtacgtgtgtgtgtgtgtgtgtgtgtgtgtgtgtgtgtgtgtgtgtggggttccagctgaattttctgtcccgaggttgagttagaaatcagcttttgtttgctttacaatttctcgtggcttcagtcaaacagtggtgtcaaatgtggtatcattgacatctgtggtagccttcgttctctgaagtctatcagcaatatccatgctgataattcagtctaaatgattgcccagccacaagctggacagtgaacactgttttctcagttgggttgggtgctcctcagggagtcccactatgccaagcagatgaagcacagtttgccattcactgagaaggagcccctgggaccccattcggtggcccaggccacatcactgcccccgaccggacccttgcctagaactgttaagtgtcaggggaatcacacaggaggaagggcagccaccacatacacacaaggaggatgttcgggtggcccccgctctcagctagaggcatctccatggagcactttgggctgagccaccttcttctctgtccccactggttcccccaccaaagtgctgcagccagcagccagagattaaaatcctcatttgggtcgagtaagaaagtttatctattacccataaaccttttcttgcaaatctgctcatgctgcatatattgactttcacatttcactctctaattgagtagaattataagtatcccttgcctattcatcctgccaaatactcaagatttctgttcaacaggctgtcctattatcagtaaactgccctcgctatgacatactaatatatatgatatgaacattgccttcttggagctctttttagtataaccgttggggtcatatcccccagtgagaaggccattagaattttggggtcaggttatttgtacatggtagtgtaactgtcaagatgtaatatctgaggggtttttttggtggaactttttgtgttgagtatagaagccaatcatgttcatatagtagacaaacttgagtgatactcgtctaaggaccacaaataccaacagtttgaagtaaaagtaggaggactgaacattattgaggcaaagtctcaggccatacctgtttctcttctctgttgtaatgccctcagccagggctaaggtgagtttttgaaagcacccatcactattgtgtgtgtgacgtggataggagaggttcagaaaaggaaacaatgaactcaataattatatttgatgctaatgatctggtctgtgggtcatgtgggtgtctcctgtctcctgatccacctaacactgatgacaaagctcattagtacctctggccagagggtggacttgaggaaagagaggacagcactcatgtcaatcagtttggcttctcattagtaactccaaagaaaatagttggccaaagaggccagaaccacaaaaaggaagctaactttgagtcacccatatctgtccactattatcacagaggtgggaaaaggctaagtgtctggtatgtggtaagtggatgaagtgaaatgatattttttaaggctaaaataaaacttgtaaaaaatctcaatggcagcagtcctaaaataaaagtaagtctttataaaagaaaaacaaagtccaaagtgaacatatttgcttctcctgctaacagtgctatttcagacactaaaaagtagtgatggattcttcttccgagcaagagggagcgtgtagctgagaccatgggcagaatgcatggtgcagcaggcaccgtggggaaggagatcagaatttgaagttccactaaactgtatcacctggcatagactccgaggtagcccgaaatccagtaggtcacactggtgtggacagaaagatcttcaagggaagcccttgcttcctgacctgagaagcaggaaaagggagtgctgacttcatagtgagtggaagaagccaccgtcctcattctctcccttcccaacccatagccagtcctgcacagcggcgtagggctgggcagacatccaaaactgtgcgtgctgggggaggaggatttccttctttctgatgaagggaactgtggtcctaagagcatggggcgaattcccattgcttttcttccctccctctgtccttctgccacttgacaccacattgaaatgcagttgtgctagaagtatgtggctgagcaaggcaactaaacccagcgttctagcagaaggaccatgaaaaagggccctagggtactggaaggtactggggagatcacagagaggatcaagagagctattgcataaaatattgtatgaactcctggactcgcttctgagctgtgcatgtttggatctcattgtagcagcattacaaacgctttgagagctgaaatatgaactagatcatacaggtcccaggctgaccactgcatggtatacatgtaagacagatccaaatagcactgcaaaagctttctgcactgaagtgacattcagctgacaggaggtggtttggaaatcgcagcctgaacttaacaatgttgatcacgtgcttaaaaaaaaattcaacattgtccttaggatttaaagactcggactctcatgatataataatcaacattactaaaaattagccagcatatgaagaattaggataatctcaatttgtatgtgaaagaacaagtaacagttgcaaatactgaggtgtcacagatgttggaattatcaaagatttaaatcagttattctaatcatggccccagaagtgtgggaatagattatgtaatgcagaagtgagtggtaattttagaactgaaatatataataatcaaaaataaaaattcatgggtgggctcaacaacagaataaagataatagaaagagaagagacagtggacttgaagatagagcaatagaaatttttcaatctcaacaacagagaaaaagattgaaaaaaaaataagtaaacagagcttcaaggatgtgtgagaccataccaaaaatgtccaacatttgtgtaatcaaagttcctaaaagagtgtgatttgaagaaataatggttggcaactaaatttggtcaaagacgtaagcttttaaatttaagaagctgaacaaacctaaacaggctaaaatcaaagaaatgcatgccctgacacatcataaactgttgaaaactaaagagagaaaaatattgaaagcaaatagggaaaaatgctacataacatataatagagcaagttgaattactgcagatttaattggtatgtttagacataccaatgatacataacatataatagaacaagttgaatgactgaagattttctgttagaaaccacaaaggccaaagtaaagtggaacactatttttaaaataaccagggaacatattatttatatacgaaggtaaaaaaatgaaattctcaaataaaagaaagcaataattcactgccagaagacttgctctaaaagaaatgctgatagacagaaaattataccagaggaaaacttgaaacatcaagagaaaaagaaaagcaacagtagtaatacctgagtaaatataattattctcttaagttctttaaaatatgtataataggccgggcgctgtggctcatgcctctgatctcagcactttgggaggccgaggtgggtggatcacgaggtgaagagatcgagaccatcctggctaacatggggaaaccccatctctactaaaaatacaaaaattagctgggcgtggtggcgcatgcctgtagtcccagctactcaggaggctgaggcaggagaattgctttaacccaggaggcagaggttgcagtgagcagagattgtgccactgcgctccagcctggtgatagagcaaaactgtgtcaaaaaatatatacacgtataataatggaaatcaaatattctagcattggtagagtttcattgtatatagatgtaacacatatgagaattgtaagataaagagaagaggttaaaaggactaaaatgatggtaagatttaccacttgaagtagtaaaatattaattctaagtagactgtgaaaagttaagtatatatatttgaaatgtgtagagcaacagctaaagacaccatacaaaggaatacagtaaaaactcaatagataaacaaaaatagagcactgaaaatattcaaataattcaaataaaattaggaaaggaaaaacaggaacaaaatgagggaagaaacctaaaataaatcataaagggtagatttaaatttcaacgtataactaattatattaaatataaatgatctaaacatacaaattaaatgacagagattgtcataatggattttttttaaatgaccaaaggatatgctatctacaggtaatacattttaaatataatgaaatgaatgtgttaaaagtaaagtgatatacactaatcataaggaagctggaggggccatattaatatcagaaatagtagactgtagagcaagaaaaattaccagggataaagaagaacattacataaagaaaaatgggtaagttcaccatgatgacataacaagcataaaaaagtgtatgtacctaacaacaaagtttcaaagtacatgaaacagaatagaactgaaaggaaaaatggacaattatagttaggggcttcaacacagctcccccaataattgcaagaacaagtagatagaatagcggtaaggatatggaaaaactgaacaatgccatcagacttgctaattgacatttataaagtgttcctccctcaaatagcagaatatacattcctttaaaatcctcagggagcattcagaaaaatagatgacagccagagacataaaacaaacctaaaaatgattaaaagaattgaaataatcaaaagtagttatcttaccataatgagatttaactagaaatcaacaaaagaaagataattgataaatctctaaatactaggaaattaaacaacctacttctaagtgatctgtgaatcaaagtctcagagaaagcagaaaatattttgaagtgaacaaaattgaaaatgcaatatatcataattcatatgaagtagctaaatcagggcttagagggaaatatggaggattaaaccctcatattagaaaagaaaaaaagaactgcaatgagcaatctaagcttctacctaaagaaactagaaaaagaagagcaaaacaagtctaaagcaagcagaaagaaggaattttataaagataagagtagatatcaatgaatttgaaaacaatagtggagaaaaccaataaaattaaaaatctggttttttaagtatatcaagagctgataaacctctagccagattgacaaggaaatatgacataaattaccattgtaaggcatgaaagagggcatatcactatagtccccacaaaaatataataagcaaacaccatcaagagctctgtgcacataaattcaacaatatagatgaaatggaccaaatcctagaaagaagaggctgccaaaactcaccccaaaatatccctttatatctcaataaattcaatgtataattagatctttaccaaaaactcaaaaatcaaaacctaaaaaactacaggtttggatggtttcactggtagaattctctgccaaacatttgtggaagaaatgacatcaattctgtaagatctttttcaaaaaacaaaagaggaggcaacatttcccaactcgttttgtgaagccagcattatcctggttaccaaaccagacaaagttagtacagtaaaagaaaactgcagaccaatgtctcttaggaacatagatgcagaaatccttcacaaaatattagtacattgaattaggcaataataaaaataataacaagtcatgaccgagtggatttaggcttggaatataaggcagcatttgaaaatcagtcaatgtagggctgggcacagtggctcacagctgtaatcccagcactttgggaggccaaggcaggcagatcatgaagtcaagaaatcgagaacatcctggccaacatggtgaaaccttgtctctactaaaaaatacaaaaattagctgagcgtggtggcacatgcctgtagtcccagctacgcaggaggctgaggcaggagaattgttttaacccaggaggtggaggttgcagtgagccaagattgcgccactgcactccagcctgggcaacagagcgagactgcgtctcaaaaacaaacaaaaaaaaagaaaatcagtcaatgtaatctatcatattaacataccaaagaagaaaaaaaccacacaataatattaacagattcagaaaaagaagttgacaaaattcaacatacattcatgatgaaagctctcaacaatctatgtaggattaaaaggaaacttccttgacctgataaagaacgtccacaaaaatctgcagctatgatagctatagacactgcagactactagagggggagggagggagggaggagggcatggattaaaaattacctgtggggtactatgctcactacctggatgacaggatcactcataccccaaacctcagtggcatgcaatatacccatgtaacaaacttgtgcatataccccatatctaaaataaaagttgaagaaaaagaaacctgtagctaacatcatacttgatggtgaaagacctaataccctccctttaagactggaaacagggcaaggatgttcacgtttaccattcctgttgaacatgatactggagtttctatccattggaataaggtaagaaaaagaaatgaaaggcttacaagctgtaataaaactgcctgtttgcaaacaacttgattgaccatatagataatcccaagaaatttacagaaaaagttcctagaatggcattgccagttagatgcaagattgtatagccagtctggaaaatagttcagtagtttcttaaaatttatttttatttttatagatttagggatgtcagtgtagttgtattaaatggatatattgtgtagtggtaaagtctgggcttttagtgtaactgtcacccaaacagtgtacattgtacccaataggcagtataataggtagtataataggtagtatttgatccctcacttcccttctaccctcctactctgaaagactcctttcagagtctttaatgtctgttattccaccctgcaataactttttgagactggcttctttcactgagcctaatgttaaaatgtatccacgggattagaagtgtgtaaggcacaacatgaaggagttctttggggtgatagagcaattccatatctgattctgctcccacttataactgtactataaatacagtttttgccttactagtaatttcacttaggataagggcctccagttccacccatgttgctgcttttgcatgcaaaagcatgatttaattcttttttatggctgagtagcattccatttcgtgtgtgtgtgtgtgtgtatcacatttttagtccagttatctgttaatgaacacttaggttggttccatatctttcctcttgtgagtagtggtgcaataaacatacaagtgcaggtgtctttttggtaaaataatttcttttcctttgggtagacacccagtagtgggattgctggatcaaaggtagttctatatttagttctttgagaaatcaccatactattttccatagaggttgtactaatttacattcccacagacagtgtataagcatttccttttctccacatcctcacaacatctgttgatcagtgatgtttttcatatgtctgttggcctcttgcctgtttttttgaaaaatttctgttcacatcctttgtccactttttaatggggttacttgtttctttcttgttgagttatttgagttccttgtagattctggctattagccctccattggatgcatagtttgcaaatattttctcccattgtgtaggatgtctgtttaccctgttgattatttcttttgctgtgcaaatgctatttagtttagttaagtcccatttgtctttttttgtttttgttgcatttccttttgaggacttagtcataaattctttgctttgaccaatgtccagaagagtttttcctagattttcttctaggattttaatagtttcaggtcttacatttaaatctttaatccatcttgatttaatttttgtatatggagtgggataggagtccaattctattcttctacatattggctttccaatttttccagcagcattgattgaatagggtgtcctttccccgtgttttatatttttgtcaacgttgtcaaagattagttggttgtagttatgtggctttatttcttggttctctattctgttccattgatttatgtatgtattttggtactagtaccatactattttggttactatagccttgtagtatcatttgaagtcaggtgatgtgatgcctccagaaactaacaaagagtctgaatagccaaagcaatcctacttcagtagtttctgatgaagttatatgtatccttaccatatgatccagcaatcccattcctagtacttgcaacagcatggatacattttaacattaggctcagtggaagaagccagtctcaaaaagttacatgctatatgattccatttatatgacactctagaaatggcaaaatgataaggaaaaataacataccagtggtttccagggattcgaagtgtgtaaggcacaacatgaagcagttctttggggtgatagagcaattccatatctgattctatcctgagtgatggcaaggaggcaaatctacacatgtgttaaaacttacagaatctgtacatcaaaagaggcctcaattttgtatatgttaattttcaaaattatgttaaaaatatgagttttcttggcaaaagtgaatggtacccgattttattattctgttctcacattgctataaagaaatacctgagactgggtgatttataaagaaaagagatttaattggcttgtgactctgcaggctgtagaggaagcatggcaggatctggttctggtgagacctcagggaacttacagtcatggcagaaggcaaagagggagccagcattgttggatggccagagcaggagaaacaaaaaggtcggggggcgggctaggtgctacacactgttaaacaaccagatctcagaataactcactcactcactgtcacaagaacggtaccgaggagatggtgttaactcattcatgagaactccacccctatgctccagtcacctcccaccaggccccacctccaacactgggaattcattacaatttgacatgagatttgtgcagggacactgatccaaaccatatcactgatattcttgtgattgcctattgattaaccagatcagtactgtccagtataattttctgagatgatgaaaatgttctgtatctgctctgtccagcattgtaaatactagctacatgtagctattgagcacttgaaataatattttattattattttaaatgttattaggaactaacagtattagttcctaattttcagttaatttaaattaaataaaattaaatattagttcctcagaaagttccatacgacactatgacataaactttttctgccctaagttcttctaatcaatgtcctaagaagacaaggaaggaaaagatgaaagtaaaaggagaaaaactgagagcttatgattttttagttaaaaatccagattctaaatatattgttaggtcttatatttcaggtcttatgttagttcctcgggaactaatattttaggcccggtcatgccgagttcacctttgtgatgagaatgtttggccagtattattcctgaggaactaatattttaattttatttaatttagattaacttataattaaatagccacacatgcctagtagctactctatttgacagcacaaatatagataattgtataatcactgtgatcttagaaaacaaattatgttatttttattcattcagagagataaaagaaattatgactagtttttacttttttacatcaggattttatgacattttctagctttataaacaaaaatgcatgatccaacttccatgaggtgatatagggaggtgatactgaggatgaggctaatgtacattaaagatgttagtaggagagtagaagtttatggctgtgatacgaaaggtgtagaggagagcaaagcccaaataatgtttacttttaagccagcgaatattggattgtttttgcgtgctgaaaataactatactttcaccaggcgaacacaacagtccggatactgttgtcattcttgtcagtagggatagaggtggacattaggagtctgtccccggatacggaggtgtcgggaaagcagcccttggaaggtccctgcaaacctccctgaactgggtgttccattgtggtgtgccccttccaactggttcaactggggactgtgagaagtacaaattcagcctggtcatgctgagttcagctttgtgatgagaatgtttggccagtatttctttactttacactccgtctggacttagtttggagcgaattttttttccttcttattcatagttttttttttttagaagtatggtgatactttcttttcatgtatgtttacttttcattcctcagttaattggaagcaccttgaggtcagaggttgattctattgctatgtctgctttgtaaaaatatggcagtctttgccaccttcatatttttttcccaattccatcttgcagggaaggaatgcaacccacagagaggataactcagttctaattaaataagccagggacaaagtcactcagtttctcagctctttgaccttataactaattccagctaaaagagctctaggactcaatagcagtatatgtttaaagcaacagaaatactgatgatagttttgaaaactaattgggaaataccatttttagggcgtatttttagatgtagttgttgtttcccaaattgggggcatatttgtcccaagggattggggccatacactggcaggtttatacatcctcaagatgaatgtggatggtctccctaaagggtcagttcacttgtaaatttgggaaagtaatattgaatggtgttcattgtaaacaaagttttaaacttttgttattaggacaatcagggttctattacagagtagaatgcatagactgtatgaatttcagggcgtcttcacagtagaatctaattgtttttcctctgcatattgggggcttctgtgggcctccatcattattctctgcagtttaaatactagatacgagatagaaacgtctgagatacactcaggcatgttttaacccagtcggttggaaataaatagtctgtaaatccaaatgctgtgtaataaaattgtaatggagaagggcaacacttcgtttttctgtgctgtctcatcgttttcttattgtttaatgttaaaacaacaaatttagaatctggctttttaactgaaaaatcataagctcctcagtttttcctcgttttactttcatcttttccttacgtgtcttctttagatattgattagaacaacttagggcagaaaaatagtttataccacaatgtggtatggaaaaaattagatatctgcatacttcatttgtaattttttatccaaagtgcacctgcggctgggcgcagtggctgacgtctgtaatcgcagcactttgggaggccgaggcaggggaatcactcgaacccaggaggtagagagggtgcagtgagccaagattgcaccagtgcaccccagcctgggcaacagagtgagactctgtctcaaacaaaacaaaacaacaaaacgcaaagtgcatctggaaaagccttacagttgacttttctttcgatatattttacaaggtgttgtggagtaatggagggacacctgcactgagaatcaggggacctgagtgctagttctggttttgctagtaaatctttgcaacctgggcaagtcaccttcccactttgggctctaggattatatacgattaagtgatgatgtactagatgtttttctgtgtctcctccagctcttacctgcacttattcagtattcccaatcctatgagaattgacttttgagaatttaagtaacagaatagccatgttcttcacttcatgttcatagtgttgctctctaatacttgtaagaacaccaagtgtattttttaaaagtatttcgtttccttacatatacagtgcaaggaaatcttacccaatttaattgaaatggtttcttccaccacttagtcaatcctgggctataaaggccctaaaaatgtaggaactttctgttttccaaactgcttttgttgagtttttaatttgtgtctttttttaaaaaaatcaattttatgcaactaagaaagtataatctgttattggtgcccagggtttttgtttagagaatttctcctcttccctttatttctcagtttgtgctagtattctaccctgggcactactccaaatgtcaggctactgctatagcacagatagtcttttcgatagattctggggaggtagtgttaggtgcgttgtgaaactcatgcatttctgatagcattgcagtatttcatgttggaaatgttggatagtacttttgtgaaacagaaaagttatctcacgtctctctgcttctctctgttccctggttaagcactctttacattttgttcactctctcacagtaggcttttaccttgcctcagtaattatcttttcctttggatgcatcctataccctgttgcctgcataacctaaacattcagcatgaggaacatctcccctgtagaaacctttaatgccattctccaggtatttaatgttatctttatcccagcctgactgactctttggccttgttgctaccaatctccttcatagatccctccaacccagccatgctgaatctaccaccagccattctccaaaacatcttagactgtctaaccacatcgtctctgttcatactgccttgctgcctggaaagacactctcatcttgcctctccccacccctttactcgcccatcctgtgtggctgcctcagtgcctcttccttcctgaagcacctctcagttccctccatgcttccttgatggcgcttttctcatatcagaaataaccatctttctttgctctcctggtcctctttccctctttgccttgaatgacatagatgctgatgttgaacaatgaatataggagcggtactcattcatcgttactgtgacctcagccacatgctaggatctcacgtgctgtgttttataagtgtgttttgagtcgaaaggaggtttagtggaatattgtcacagactaggattgttttctccccgactggtgcagtcttgaaaaaggaagagaatcttgacaccgcagacttctgagttgtgataggagtccaagaagtccctgggggaagccgcgtctgaccatattgtcagcatcccttccctcctgggagttgccatgagcttataaatgtttttggagaatggaggtgtcaggcttctttgggaggagacttactaagggccatctagcaaatgctgagtgaaactcattgcaaatataaagtgggccattttcctatccattaaagactgttctttaaattttttttaattgattaatttttagagaaggatcttgctctctttcccaggctgaagtgcagtggtgcaatcatagctcactgcagccttgaactcctgccctcaagtgatattcctgcctcccaaagtgctgggattacaggcatgagccaccgtgcgccatgttctgaatctgaccttgggccacccctcttgccttctcttcctctacttcccagtaatgaaccctcagccccaggcaggcctgcctgccttatgatccccacctccctcccatccacacctccacaccttgtccatgcttcctccctgcaggtcagtcctctccttccttcagcatagatttagggtctgctgttggctagccactttcagggatatacctgtaaacacaaaacatgcaaaaagtatccctgctcatggagcttatgttatgacatatgggctgtgctttctcttttctttcacctgtccagattctagaacaagttggcctttccgtggaagccattgctgactgtttcgaccccggttcttttcttcaaaattcttgggggcactggttacctgttcctcccctttgaaatacactgccttgtatttttgcactttttatatgtgagtatcttacctcctcaagtacatttgaagcttcttgagggcagacaccatgtcatttgtccatgagagagtgtgcaccaaggtttgtatactccatatgtacacaaccttaaagattaaaatttaaattcctgaactgaccataggactttgcagttaggcacctgataaatatttttaattgatttaatggtatttattgctgtctgctttttcaagtggagcagctctaagagcatgcgagaccattagccatcaagcgtttattaagatcctccccgtgtccctatgtgacgctgctatttaatctgctgccaaggacgcaggcgagtgccaagcacagcctctgcccacacttcatcaactgagcaaatcacctctgcggtcctctgtgtgatgttcgtaaagctttactgtaacaccgaagctgttatccaaagatgtaagaggcacggggccaggaggaggactgctaatgatggctgcatgtgattcttgagctcatcttgccatcagacgccgagatttaaagcatcagcagaccgttcttgtctttgtttctcagtggaggccaatggtgtccattatgaaacccaccgtactctcggtagggcagcaagatgagcttgtggtggttttgcctgaccgtgtatattcttttccatggtccttcaataaaagtctactcaggggcagtcgttaggggtcatagaccccagcagaagcaacttctacgggagaccccacttgtgaccttgacctcattggtccatgtgccaagtaagcagattgtgttcaatctaaatttaaaaattgacatataggttttgacatttttttgtttacagtggcttttttattttaattatcaagaggtaacacgtgttgttgaaagaacagactttcaacagcaatggttgttgaagatgattcatgtaggaagtctgtagaacagcatacataaacgtgtaaaaggtaaaattgactttcagtggctgaaagaacagactcgagagccagctgccttgggttgaaatcccatctctgccgttcaccagctctgtgagcttcaggaagagagttcccctctttaagtggggctcacaccagtacttaactttcagagtccttgtgaagatgatgtgagtttctaagtacagacatactaggcccatatatagatgaaaacatgcatgcttggatattagaaattatgactacatttttatttgtacattctcatcccttcgagtatttggattttttttctttctccacatatttaacctttcatagatcatagaagaaacttgtgtctttaactgtcaggaggtggtacagtgacccagggcttcccagaaggctcttacactgccaggactacagatatgtctgtttagatatgaatttgtaatacatttgttatatgcttccatcattgcattcttaaggtgcgtgtgcttattaggcaccctgtctgaccttacagtgatcagaccacgcccgacaggaatgggctggattacatgggtttgggtggatttatatccaacaacacagccagacttaaagaggtttgatgaaaggcgagtggctttgtttggaggcgctggtgctgggccctaggctcagtctgtggcatgcatgagaagctagtggcttatcaacgaggagagaaaatcataccctagaagggaaaatcaagaccgtatttggttaagtatgtggagaaagaaaaaaaaaacaaatacttgaagaaaagggatgagaatgtataaataaaaatgtagtcataatttctaatatccaaacatgtatgttttcatctgtatatggcctattaggtccttatatgcttctgatcaagcatacaaggtaaaattgatgaggctgttaaaaagtgcatcagtagcagttggtgtggaacacattctcaagggggtcacagggtgacagatagtccaggacagggaggagacagtgccacggggaggactcagcaggaggatgccacgtcgtcagagggaaatggatacgccagaccagagcaaaggggggaccccaggagggcagaggatgtgaaaagcgttaggtggttgagggcatggaagacgttttatttaataacattcaaagcaagcatctcaatggatcagtagatgaatatatagtctgcatgcctgctgagtgtcccagactctaggcagctagagaagagctgatctgggcacagggacctggttagtgtttgtagctatcggatgggtgatggcgcagaagcgggttatacgttttgtagcctcccgaggacagaatggatgtcactgtgcaggggtgacaagagacgctgatttgaactcaactcacaggggggcctttgccagagcctgagctctgttgggggaggttctggaggacaggctgaatcaccggagtcaggagaggataggacgctttcaggattttagccgggagacccacgtggggacccctgtaactctgagtttcgggggcgccttatgaagagcttcagtgcatttcccatctttgctggcaccccacattttgtgcccctggtagctgagctgctgggttcatgaggatgtgggagaatttgctgcagaatcgtctgccacccacctctatgggtttctgagaatgagataatttttcggttatccggatcctgagcggaggcagcgagcggtgcctgttttggcgttattggatttgggagagttcggcagtaccactgccgtgagattcgtttccttggcctctctgactccatttttctcgggttttatgtggctgctctactccttccattgtgttctctctctcaactgccgcccccgtcttcctcctgagatgtttacgtgttgcttcttgcactctaaataaagactacatgttttctctgctggcataaattcctctgtgtgtgtgtgtgtgtcggtgtgtaaatgcatgtccgcaggtgtacacgtgagtgattcagcctggggttcacaatgagcgtggcacccgtagtgcaatgaaaaggacatttttatgcagatacgtgattcattttcaccttgctgatcttagccgtagacatttttaagaaacaggggaggaaccagccaccccccaaatcccatgaatcccacttctcggtgcgattggagttgtgttgtaagcgcaggagaggctcctgctgagagcgagctcctgacatagtgacctcattccccacgccgccctcctcgcagcggcagaagccgcactggctggtgctgggtgagctccaccgctgcccgggctgcgagcctgacggctgtgtgtcgggaatgacgagacccaggcttgcaaagacttgcacggcaactggaatttatgacaaatagctcactgcagctaaactttgatacagtgtacagtagaaccgcctgttacacacaggagggagacgcgtccttcgtcaccatgcaaagccagccttaacacaacataggaaaatgtggcaggtctctaattacggactggtgagtatatgacgccagatcaattttaatgtgtgtgttctctcttcaagcatctggaggtatgtgccctttttacctttttcatgattaaaaaaatatgagttggtgctaatgcatgggaggggacctgggccccttggagaggagagtgtgcccctcgccaccccgcgcctggggtacattctgacctcgcgtctccgcactgcacagacaaaggagcctgcacagacaaacagaggctgtagcttttcttggagcgatgactcatttcagttcacaaaggattctgggcagggcagtgagaagtcaggttggctgatccgtccctgtgacttcactttgcagagaacaagcagaagaggagtgacactgcagattccgaggcactgcagtgggatgttggctcagcaagtggctgtgatgtacgggataggcatggaacaggattccagctgttccatgcaaataggataaaagaatggtaaagaggattcctttttttttccctcctcaaaacgttaccagcaaagtacattcacagagcctttttaaggtgccttttgccagcttttgaactgaacttgtaccagtatctcaagccctgaattgtaagaagagctgagagttctggaactcatttttaaaaagtagatctacgaaggtaaagtaccagattcctcttgtgttccacgggccctcagtagccaatctgaaatgctcatttaggatactatgacttgaaactttactctttcttcttattccagattctaggacgtccgtttctgttactggctccttcttgtgcttggatgcagctccctagcatgcaccaggctttagcgtcagtgctacctgggggatggagccagtccagaaagggccaggtaggtttcccctgcttttatttcaacagttgttgtgtgcaaaggaatatggtgaaatgtcagcaccacccgtgaagagggtgcacggtcctctgagaagtcttgctgttccgctcctcccgcagcctcaatcttaggcagtccaggtcctcccactgtgggctgcccaccacacacgacctcaccagcccaggtcatcccagagctgctcacggggaccgagaagtccacagcagcaggatttgccaataggaaataatcagactgccccagatttccctcagctgtatatctatctcgctcgctgctctgagggaggcattcagtaaatagtatttgacattttttctggttttttttttttttttttttttttgtttgtttggtttggtttggttttttgagacagagttttgctcttgttgcccaggctggagtgcaatggtgtgatctcagctcactgcaacctccgcttcccgggttcaagcgattcttctgcctcagcctcttgagtagctgggattacaggcacgtgccaccacgcctggctaattttgtatttttagtagggacggggtttctccacattggttaggctggtcttgaacttctgacctctgttgacctgcctgccttggcctcccaaagtgctgggattacaggcgtgagccactgtgcccggcctcgacattttttcttaccaattaatatatagtgcccgaaattttgcatactgtttggcctgttaacctacatgcaatgcactaaaatccaagaaagcctgatttatgtgcccagggactgtttccaagactaacatcatattgaggctgctgttaactgctaaggaagtaagcatatttcatcatagtctgctttaggattcagattatgacagagctgttttcttacaacatccatgggcttttcacacgaaagctttttaaaaaaacatgacaacgaaatggtaaattttggtcctcaaaagtacattacatgcctcatttccaaagtgagacttggcacatctgaaagcatggctttaccccctcatcacatggatggtttcagcactgttacagatatttctgagagtgttgaatcccgtatgtaataggtaagaatttttagaacatgtttaaaggcagatgttcaagaccccttgaacatcttctttctcttcgcagtcacatccatctcatagctcaccctgtcacagaagaaaagagagcatgtttcctttctccactgtcagaggtctcttctttctgcatagcagtttgcatcttcagagcaacgttgaggatgctgagtcaggtttaaaggatgtttggtcagaaaaaacacaagcatggtatgttgcaaatacagttccatcatgtcctcacacccatcaattctacccatccttaaggacctattccaaatctctgtcccctggaaagttctccctaatcaccccaacaggaggtcatttctaaatccttgaaactcccattatagagttaagtttctattcattcatgtgttttcttgctatagctcttctaagggtgttttgaacagcaatgtgtatatttcatgatgctttatattttcacacatgtatatcttatattcccacctaaattgtaatctcattgaaggcagagatcaagatttatgcttttttctgctgtctacatctcctagcagttccctacacatggaaccctttcaataaatagttgaataggaagaggggcagtttaaaaagcaggatttttttttttttttttttttttttttttttttttttggtcatagagagttagaatgatctggttttgctaattttaagaatcttcacagggtatattcaggctaaggtggacctcaggagtcatgcatgccactctagaagttgtgatggttcttaccctgagacagtgtcacagccaggaagctgccttaccctgcttgtaaagaactgttgccgtaaaggacaaatgagcatgtggacattgatcacggtttacttgaattatattggacaagccatccttaagttatgaggagtatgccgaattcgggaagtttaggtgaaagtcacttttttgactcctacaggacattttccttagaagaaagagccagaatggttactaataattcggatcatatcagaaattatttaactcctggtgtcactgatttttaatactaagagtacttatttaagtcctgagtttcctttccctttcttaggtaatggattggcccaacctaagttttgaaataggtcaacatcctttgatatccttgtaattctctatccacactatttcccatctcctagtgcctttttctctccaaagtccctagtgtaatgcatgtttgcactcccagcctggtgatgcatcccaaatgctatgtgttctatatatctgattaaagtaatcttattaaactacttcatactagtataaggaagacctctgcactcttagccttcccaaagatattttagttttttaaaaaggcttatttttaggtacaaacaaattttccattggtagaaattcaaacactgtaaatgagtaaattggataaatctagatgggcttgaggaagaatttttttttttttttgacggagtctttccttgtttcccaggctggagtgcaatggcacggtcttggctcactgcaacctccgcctcctgggttcaagtgattctcccgcctcagccacccgagtagctgggattacaggcatctgccaccacgcctggctaattttttgtgtttttcgtagtgatggggtttctccatgttggccaggctggtcttgaactcctgacctgatccacccacctcgacctcccaaagtgctgggattacaagcatgagccaccgcgcccggccagggaagatatttttaatactagctactatttattaaacatgtattaggtctcagggacagggtaagcactcaacatccattatctcatttaatcccctcagtgagtctacaaggtaaacatcattatgtatacttcacaaaagaaaaaattgaaactcaaaaaattaaataatttgccccaaatcacacaaccagtgaggagcagaactgggctctgaacctaaagttttgactacaaagcccatggcttttaacaccatcttgtaatgctgaattgaagagagaaaagttacttaattgtacagcgacttagacgtttcctctgtgtatctgatctgatcccctatcctttctttcatgcctctgaattctgacatagtcctttcataatgacctccatggcagttggaaggggtagaagcgtgttcggttttaggggggttggttggtagcagtcaatcggtacaattttgttgtaatttgggaactgtcaacctgtccatatttgtagtttatttaattaggccttcctgtcctattacaattgtattttacagaaatcagtcccactacagttgtcatccctaaactgatgaagcagagaatacaaagactgagaaatagctctggtgattccaacttaaaaagagggaaagtgaatgtgtgacctagagttgttagatgatttattaagctgaagttgggaaatatcatcagtggaaactggagcatctaatgtctagtgttaggccaggttatgctgcagaatgaacatgaaggagaagtacagggtggcttaaaataggaatttatgttctttcttatgtgatgcacttaaggaaaaggaagacgtcatgttcctcaggtgctcttgttggtcaggtgctttacagaatttcaggacatctgggagatcttactaattgttatcatctaggactggtatttcatcataactttatccttgttggtaagtggctttaccttcattctggttgaaggactggagcacaagtggcagctggtgttggaaaacatcttgtaaggtagcagggccttgcctcttcttgtttatgtacgtaggaccttttgattctacaagcatttgaggacctgccgtgtgaaagcattcggctaggttttattccatgtgcctagcacgtaccaccctggacctagctgatgggttatagtgtggagccttagcaaaggcgttaattacgaaattaacctgattggtcccagggctcatattccatcctaccttttctgctatgcatctattgcaaatagctaaatggtccaacagaagtgttagttgttcctatcagagacgtcaggaatcacctctggcggtggggaaggtggctcttggccagggcgctctcacccacccctgcccacgaggatggcccctttctgcccgatgctctaccctttctgccttatctgtctctatttattctgtgataagcttttacctgtagtcaaatctcagtaacaagagcaatagctaatgtgactaacgaaaggttgcggactgggaggatcatgagcttcttctgtagaccaatgagccaattaattcgttacttcacatagtggcattagacagactggtcagcacaaaggcccgggtgacgtgggggatgttaactcattcttttgggtgcccttggccaccgtgttactctcgtttaactttattcccattagaagtttcttagtaagtaatagctaatggacaccagtatttcagtatgattaatgagtgtcttctgtttacgctctcttgattaaaatgatttactcaaataatagcttaggaattggacctgctttaagatacccattaagtgttgaagtaaagcattaggaaacatttttaaagttgttatagaatctctaaatattctaaaattccttttttatgctgtttccttcagttgactattgccatcgggctcagccttcaacttttgaaatcagtggcatttgaaacaaacctacagtaaactagtaaaagtgccttttcattgccagttttcttctgaatgtcaaatacaaacattcgaaagtcaagaatagtcatctggtttcaaaggaaagctgcttaaaacgcaggagcatgtgaggtaatgggagccgtctgctctgcccccaccagatgggtgctgtggtcttcaagagagcgcataggaaagaagtatgtgggtttttttagaacagctttttaaaaaatactgtagtaggccttctgttaaaagagccaaacagcattaatacataaaattggggttaataaattgaattaaattgtaaaacacaagatttgtctgaggcgctgcatccgagaagttgttcacttgactgtaaccccagaaagcgggtgatttccccaagcccaagggcatttaagataaaacttggcgaaagaatcgttttctgaagagtgtgcggagaggaatagagttgtgttgtccccatgcccatagtgcattttatagacatgtttgactatttttatgaggaatcacggtatctactacttgtggtaattttatggcatccgtgattttaacttgcgtgttaattttggcggtgcagagaacaaaaggggcacacattagtcctgaggaacaaagctgagcaagactttgaatttagaaagagaaaatgatgaagcctttattgtaagggaagaaaaaattattagccagtatatggagccatttctttgaaaattaaagcccaactttttcagttcagatgagtgttaaaatagtgtccccagcgtgatggaagcagagctagacacccgtgccatatgatgcttttatgccagaattctgctgcattcatataggatcacaggatttaggaggctgaaggaatctttgaaatcatttcatccaaactctcattttacagatgaggaaacgggcgcagagcggataattgtattttgttttaagagactgggtacttatcaaaatatctcttgaatgctttttttatattgggaatttctcaattataaactagtacagtttcagaaccacattcttaagtgggttgttttggtacaagaatttcattaatgtcaaagataactcttcaacccagagaatagattacattaacacttgcaatgaaaaacagtaccttaaaaggaaaacaggataattcatatggaatgttggtgcttgaaaaaaaaattatttaaagaaagctaagatagaggatggaggctggtactttccaggctgtttactgtgatgcagtttgcctggggaaattctggctttccttttcttacacagttgtatgaggatgggtactttaagatgaaatgacatagttttatgttggcttttgtagcaggtatcttttggaaagctacggatgtcacccaggaaggagcaggtgtaagctgttgtgaaagtcatatcccaggagcggtgctggtctcctgcgtgtgcacaggctgagaagttcctggaacctcaattaatgactgcaaaaagtgaaaatgccacttataaaggacagggctttattttagtcttttttttttttttttttttttttttttttttgcacaaatagaaccgagataagaacagttttggaacttgagtgcttaaaggtatttgatgtaaaataggcattcagatatttcttgaaaggatgaattatgtgagagagagttttttttaaaataactccaactaaagtaatgggccagaagttggaaggggaaaatagatagagggatttaaatagtgaaaatggatgcgcttgataaagctatttcctgaggtaggggtgactagctgtagacaatccaagagcaggttggcgtctgcaggacatctgcctgttgtccgttgtgcgagtgattttaggaatcaccagctctttctccagagttgcacaagagtgattttctcatgcaagcatatcatgtgatttgtctgtatgaaaacaggggcagtgcctcgtcaccgtcaagaataagatctaagccttcttgtcaaccaggatctggccccttttttctctgtatctcaccaccagcctgccccaggggagcctgaacctgccgcagctccccagtctcagctccccgggctgcctgggctcagcatgctgcacccccgtgctggctgggctgttccgcctctcctggagggggtccgtcttccatgcccctcatcatccacccggctactctttctcttcatgccagtcagccgacaatgacctcacatgaaagcagtgtccacattttcactcatgcattttaaatgttaaatactcttaaaacagaagtttacttacaattgtaatattttcatgtcttttcacattttaagctcgcttaaaaatctatggaatgcttcctctgtccaaggcactgagtttggttttatctgaaatagcctagatttgacaaaagtcctctgaggactgtacttaaatggatgtttgtaagaaaataaagctgaactaaaatctatctactccttttttagaacaataggacagaattatagcagtttagaaagaattttttagctgacaaagtgccaatgtgctttaagatgagttgtcgttatgaatgtgttctgaactaattctgacgatggaaaaatccatcctataaattatagacaagtaaattataatccacatttcatgcaaaatatggtagtttctgtagataatgtagattatcgtgaccaacaatattttagcagtacctacattctccttttttcttctttgaataaataaatgtggtccggtagttggaagaattttctagtagcatatcttaaaaatgactagttggctcgttaagcaggtttatataagatccacagaagattatggtaaacttgaataatgtttatgttgtgttgagagatacctgtgattcctttaatacagatcttaaatgcatgttctaaacttcacttaatatataattattcttttaaaaaatttactcatttttattaatttttaatttcttattgctatataatagttgtgttataaagttatttttctatagtaactgctgtgtttggaggcctatttctcatgcagttaattgggggagtcttagaaattgcatgggtaaacttatttgttctctttttgtttgctattatttagcaaaaatattaataaaattacagtcctttaagatgactaagaaattccttagattatcatgttaaaaatggatattcattcattcaacaaatatttgttgggtaagcactgcatcattctaggtgctgggaatgtggcattcacgttgccttctgtcatggagcttacattcaagtgggtgagacagacagtaaaccagtgaaccaaacgcacatgcacacatgcagggagagaagacagtaaactcggctgtgatggaatggcagtagaccagacagtcaggttagggctttctgatgaggtgccatttgaattgagacctaaagcatgaaaagccagtcttgaaaggtcgacccaaggagcatcccaggccaagggcacaaaaaatacaaaggccctgagttgaggaaatgcctgacatgttcaaagaacagaggaggtcgtgagtggcaagtaaggatggaggtgggagtggtcctagcatagggtggacaggctcaggccacgtgggcccgtgtaggcctaccaaggagttcagcttctcttctaagtgcagtaggcagtccctggaggattttatgcagggaagtggtgtgttttttgttttcctaagaggaccttgcctgctctgtggagaggggagtgttggaggcaggagggaaggctgaacatcatcaagttcttatgaaggaccaggtgagagatgatggcagtttaagggagctccagggatagaatccaggggacaggccaggaagcatttgggtgtagacaggattgctgatgggattggggatgggaaaggagttgaaagtaatatatcttagtgcagcacaaaaatgagatgaggtggagacagttacttagaacatccaaattccattttgttctacattctgagttaaaagttattgcccatattcattattatagtgaaactgagcttttccaaagtaaatgccattcagacacacttaaagcatgctgcctcttggagttggctgcaatgaatgaaaagaaattaactgagaatatggcagtgaaaccaaacaaattgtttcagctaaacccataaggacaagcatgacctaaaccaaagcagttaattaattttgctaatagtcatttcttttttacagagagttcgagtttcctcttatgacctatacaaaaatctggaaatagtccggcctgcattttggggatcatatttagtatttttgtatctttcatcttctgagatgttcttagttatataataggcacacgttggaaggtattaacttctcaagtgatacccaagtccagaggttctggaatctgcattgatcctgtccctctttgccagctgatcccatcttccttttcatctgactttaaaaatcatcccaggtgactttcaggtccatatggctaacttagcacctctgtaagaaagccggcctcagtgcccctgtcctatccagtggaggtggagtgagagagaaggaactacaggccggtgtctcagactgtctgtgcctgagctgtagggcctgcggtacggagggcagagtcaaacaggtgaacttcccaactcccacctctgctgcagcttgcatcagcactcagccaatcttcacacatttcttatgtgtttattgatttagagacagggtctcgctctgttgcccaggctggagtgcagtggcgcaatctcagctcaccgtagccttgacctcccaggctcaagcgatcttcccagctcagcctcccaagcagctgagaccacaggcgcgtgccagcatgcctggctaatttttgtattttttgtagagatggggtctcatcatgttgcccaggctggtctcaaactcctgggctaaaacaatctgcctgccttgacctctagaactgttgggattataggtgtgagccaccatgcccaacccacattaggttttagagtaagacttcatttgggctgggcatggtggctcacacctgtaattccagcgctttaagaggtggccggactgtagtcctagctatttggaagcctgaggtaggaggatctcttgagttcaaggttgcagtgagctatgattgtgccatttcactctagcctgagccacagagccagaccctgtctcaaaaaagcaaacaaacaaaaaaacaaaaacaaatgaacaaacaaaaaaacccagctttttttgtaggaaaaaaaaggatatgacaaatcttttctttaagatttaaatacattgttctaggccgttggaaacttacccactgaggtggtcccagcccacgtcattctatcattctgtcatttttgagttaccaatacgaactgagcttcaccagccaatgaatgaaactcacatcccccaaaatggccccaagttcacactcggtctcgcctgctactgccccacaaaatattacaagaatttttctgagggtgtctctttatgatgcctatgacccataggccccagacatttgtggcttctaagctaggtcagttcctggcttctgctgatttttctcccttcctccttttctggatgtgggtactcctgtctccctctggccactgggacaacgtcttatcctcctcatatccatcttgcagagagtggagctacagtagagctgatgggagccccatgtggtccagggaaaggggggcgttgaactgagctgggtttgggaagggggtgaggcctgagccttgggcactggagtcctgctgcttcctccgaggcacctgttggactctccccgtacgtgctgatctttgtcccaggccctgctgcctgatttcatcgagcaaaccatttctctcctagcccatcaaagcagcaagtttttccccatagggactctgcactcctcctgcaaactaggaactgtggctgggcatggctttaagtgcctgacagtgaggaggttggtccacctcagagcagccagacaccttgtcggggagggtgttgcttaatgctacaggccgacctgagtctcggttttggtcaaccatggtagcttattacaagcatgcttcagaaacaaaaaaggctagattatggaagtacatttaggaaatcagattagaaacttaacagaccctgtgagcccttctatgttctactgtgttgatagtttgcatcctcctcgtgtaggacatcttttcaaatgcaaccttggagaaccccaggtataaaacaggtggcacccaggtgtcaggagcgaactttcctgccctcccagcctctgcttctactgggggcacctccatcccagaaatattccaagaaattctagggatccttggagcatcacttgaaaatcactgactgcactgtggtataaagacttgagaaatgaagacagatatttgcattgtaggttgacatctcaagagtcaccgtccatcacccctccgatgcagggtcttcagcctctcctgcctccactggcccttttagtgtgcaggaggccacattctctgagggaattgtaatctgccttctcccactcctcccagccatcatccccacggccaccacagtcatctttctgaaatccacacctgccttcagccttccatggctcaccacccctcatagaatgcagagcttggacactcagctctttattcatggtcgtccctacctacctgtcccccttcgcttctgtgccccagaaaacatctgcttataggtcccagccccgcagggacacacctactcttgaacactgggttcagattacacttccttggtggaaccttggaaattcctgcttctgagccccaccctcgcctcccagaggtgttatccttcctcgactctcagcacccaggtgttgttctgttctcttgtgtgcctgccacgcagcattgcgaacttcgttcgatctacttgtctgtcttctccacttaaatagaaactgagggcagagatgtttggggagaggcgcgcactctgtctctgcagctcccgttcccccagcagacacgtaaacgcgttcaatgtgtgaatgaatgaatcatcaagttacacaaatgcaatttgtcgggatatgaatggcagttattaaataaatcagctccaagttaataaaaacggaaataaaagcctgttgttgcaagactttcagtactaggactatttaaatgagatctcggatgttaaagggaagttttatttgttgaggcagtaggagcttccactgcgtgtggaagtctttccacctgagtggaattggctgtggcttctgtgttcagagtggaattggcaagcagctgctatgttcggagctgactgtgttcgtcagaccagggccagatggacgcgtgaaggcgtgtgtctgacagatgaccgggtcttttaatgaaccactcacttgaaaattgtctttctgcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtaacgaggcgggaacgtagcactttccaggtggcggtgtgctgtggtcgctctaggactcacgtggactgttctgcccatgtttaaagagaataggaaaacattcttccccaaaactgacccgaagctttccttacttctgtaattaaaaattcaggcacctgcatgacatcaaaaaataacttaactgcttcagctgtaatactttttaaattggcaccgagaggaagaaattaattcagaatccatgaagaatctggcaagaatgaccaggactccagtcagtctttgcaaactaatctttaaatacatgaacgtgagggttcaacggctgaaaactttagtcctagggagttaaactacagaaagggtcatgtcaaaaattaacatatcttacatatttgtatcatggcttgatgagttttaagaaaataatattgataaattaggatttcattttaaaaaataaaatacttacttttctcttaaatgttataaaaaggaggcaacagcccagctgctgtgtgagaggcatttgacgctttcagtgctggaaggcattaggaagggtgacaagctgcagaatgcaggaccctctttcaagagagccagtgtattgtcaccccacccccaaatggagatcctgccagagttgccaatctcatgtttcaagacaatctggaaatttggtcttatgtgaaatctctgcatttccttaaatattgacaattgtgtgtgtgtatatgttttaatgtctgtgtgccagcaacatgcaagtcaaatgaaatacattatcgggctaccagtttgccaacttggtgtggactcagcctgtttctaggttgaaatagagattatattaaaagggaacgtttgctatatttctcattcaacttagaagagatctgagtaaatataagctgttaattgtatcagttagcttttgctacaaaaatgctgggtaacaaacaactacagaacatcaaaggcctacggcaacaagagttgatttcattcatgcctctgtgggttccccaggagtcagctgagccaggtggggcccagcagggtagttctgctccatctgtacccatccgatttagaaaacggggcaaatggagatctccttcacttgcgggatggcagaggcaccagagcacaagcccatggcacgaaggctcttcaagctttgttcatgccagcccattaacactgcagtgaccaacacaaacctgctaaactcaaagtcaaggtgtggggaagtgcaccccacacatgggaagagaacgggaggacgaattctaagctaaggagagatcttatctactgtattggtctccctgcttctccttttgtccccgaggaacgttttctccttctccttgtgatatttcttcctttttcaatattctaattaatgtgttttgataatatgtatatggttcaaaatctctaacatgaacccacccttgcaacatacaaattattttaagatttctagcattttattatctctgaatattcttcactgtctgattgcctgtctctttttgttaagtcctaggcaaacgcctttccttttagtagtgagagaaacagaatcccaggtgagagccacctaagtggggacagatagtgttgccaaacacagtggtcttggaggaaggacctgctttctgtcctatgagtgcgtagccacttctgacattgaacaacccagcagctttttaaatccttttatttttatatagcttcatgagaaatcacacggcttttctgaaattggttacgtaccacccatttttgggctctaaaataaataatggaaagaacatacagccagtgtgtaatagtaaaatgctcctcactgccaagcagctgataacaatatcactaacttggaatgctttgtggattaatccataggtcatttgtacttaaaagaataactgttttgctagcttttatgggaagagaacttaaatcccaaggccctggttttcagacagactgaggagctttttcttctgtgtgacactgatgactcattggtcagcctcagaagtttgcaaggacaccatacaaacccaggtctagcgcaggagtttgctaacctgcaggcctagtgcggcccaccacctgtttttgtaaataaagttttattggaacacagccgtgcccatttgctcatggatggtctttggctccttatgcgatagtggcagagttgagtagtagcaatggaggtcatatggctaaaagcctaaaatatttactatgtggttctttacagagaaagtctgctgacccctgggctaggatatggtggtaactatttaaagttatgttcagcaatagctccagattttaaactggtatttcataaaaaatgaaagtttgtttcctgcctgcctgccttctttcctttcttcttagctacctttctcctttccttcccttccttcctttgatttttttttttgtctgtcttttactatcagttaagctacagcagaagaaaatattttagaaaatctaaccctttaaattctacttgaaaattgtatttttaatgacaatgctaaaactctgaagggatttaaagatcatatttatattttttgtttttaaaggtaagaataaagtatttagttcttttatatcttactattcaaaaataaagtttttgagcctaagtattattaaaatatttggatctcatatttaatgtatattttataaatcaaaagtgtagtctagaatttggcttcttttcttgttttgggcatccatattctaaagaaagtttttagtgaatagtcttccagcaaaaatttctgggtcaggcgcagtggctcatgcctgtaatcccagcactttgggaggccgaggcgggcggatcacgacgtcaagagatcgagaccatcctggttaacacggtgaaaccccgtctctactaaaaatacaaaaaaattagccgggcttggtggcgggcgcctgtagtcccagctactcgggaggctgaggcaggagaatggcgtgaacccgggaggccgagcttgcagtgagctgagatcacgccactgcactccagcctgggcgacagagcgagactccgtttcaaaaacaaaaacaaaaaaaaaattccgatacatcaaaacttaaacctttttatcacttttctataaaagtgagaaaaacaagttggctgaatttttgaaaaccaactcaacaacttttatctatcaatttccattacagaatcaagaatatttttaaaaggtttataaagaataatacttgcttcttgtatttctaaataactatgcatccattcatccagaatgatcatttaaattggtggtctggtacctgttaagctgttacaactgaatctttctgggaggaagactggtcttcagggacatagagctagaccctataagtccaggtatggagctgaacttgactttagagattcctggagaatgttaatagatacactgtgttctgtctcccattcgtctccttatgttggctcttactgaattcttcttcagccagcgttcttcacaaacaagaataatctaaagatgctcattaaagcgtttcacttgaaagtgcttaacatacagaacaggtccatgtgctcactgttctgacagtttgtcagatttgcaggactaaagcaatacatagaggctgattgtggtggctcacacctataatcccagcaatttgggaggccgaggtgggcggatcacttgaggccaggagtttgagaccaatgtggccaacatgacgaaaccttgtctctactaaaaaatacaaaaattagctgggcgtgtggcacgcacctgtaatcccagctactcggtggctgaggtacaataatcacttgaacccggaggtggaggtttcagtgagccaagattgtgccactgcactccagcttgggtgacagagtgagacgatatctcaaaaaaaaaaaaaaaaaaattcataggtataagtagaccacagtgtcatgcagtgttttaaaatagttatttttgctttgaaaaatgtaaaggtgtggaagagatcaggttcaggcctgttaggatgtaaagtttatttttgttctttaagccctcacaatctgaactcatgatgaactttcggagtcgaatttggaagtagtggaatatgcaaacgttaaacatccatcacaaccatcactttctcaggtcaaccctacagatttctggcagaaccctgaatttcacaatcagtcagtatattagggcttcataatacaatgataatcataaacataagcaactttcagttaagtctgaaaactctcaggtcacagcatggaaaatggcttggacagggggcaaagaatgtttctagtttgcattatcaaattaaacattatttgatggatatacctggaaacccaagacataaaaaaatttaagcacaaatactctatggaaatagaaaaatttttctctatttttctttttattccttcatttgagaactactagagaacttgtttttaatggtaagtaaagatgtttgcattgtagtcataattctatacattaatagctttatgagtttcctaagatcatcatttggaaggcctacagtcagcaaattctataataaaattaaacttttgctttatagtaatagctatttttatgacgtatacatcagctttcccttattaggagccatggtaaactggtcaatcatgaatacttataaatgaaccttacgagtgtttgaaaaagtttgtcacattgttgactaaaagtatgctaccatttaagatgtggtcggctttaaacatgggcttgttatcttgattgctgtgccaaacaatgacagtgggcatcattcctgagactgcggtgcagaggtgtgccctcatctcagaaggtatattccgtgtcagtggtgtcccctgaagttattcagtggaaggcactttgggaagcaggggcgggaagatcacttgagcccaggagttcgagaccaacctggggggcaacatggagaaaccccatctctacaaaaaatataaaaattagtcccagctactcgaaaaactgaggtgggaggatcacctgagcctggggaagttgaggctgcagtgagctgagatcttgtcactgcactccagcctgcgcaagggtgagaccctgtctcaaaaaaaaaaaaaaaaaaaggaaaaaagaaaaaaattcatttctattttgtacagaaagtattataaaattaaaaaacaccagcactttgggaggccgaggcgggcggatcacgaggtcagcagatcgaaaccatcccggctaaaacggtgaaaccccgtctctactaaaaatacaaaaaattagctgggcgtagtggcgggcgcctgtagtcccagctacttgggaggctgaggcaggagaatggcgtgaacccaggaggcggagcttgcagtgagccgagatcccgccactgcactccagcctgggcgacagagcgagactctgtctcaaaaaaaaaaaaaaaaacaaaacaaaaaaaaaattttgttattattggtcttaaaatcatttgtataaaaactaatgctcacttgccagaagtaaagtattagactaaaaggaaaccatgcgactcaaaaattaaataattatattgatacattatctatgaacaatgctaccttttccgccttggtcactaaagataccttctgaagatggtaacacaaatgggtgtgtatgttaccgcgcattcacggattttctccccttgagaatcccaggccatttctaatacctttatttcctactttggaaggacttggggagttgaagcatctcagctgacccaggtgttctaggttggtgcacattgttgtttgaaggcaatctggttttccgtgggtcccgacccaaagtggagactaactcccagctaatgtttattgagcactctctgtgtgccaggcactgctccacacacgaaactcctttcacctcagccctgtggctacaggtactattgttatctaccttttgatgacagtgaatggaggctcagagaggctgagctgcctaaggtggtaccagctgtcttcatttgctaggactgctgtaacaaagtgcagatggctcaaccaaccaacatgtattgtcctacagttctggaggccagaagtccagaatcacaatctcagcaggattggttgtccttctgagagctgtgagggccctgtcctcggcttacggatggccaccttctgtgtgtctcctcacactgtcttccctctgtgcctttctgtctccagctttccccttttcagaaggacatcagtcgtattcgattagagaccgctctaacgacctcattttgacctgactttaagaccctttctccaaatagagtcatatttaaaagagtattaggagttaggatttcaggatataaattggggtggggagtgcataattcaaccagtgacaccagctaacaatgacagggcagggtttcaatccagcagcccggccccagccttttagtctccaccttacactgccttattcgtgtttggttgaaccacatgcaactgccatttttgtgagtcagatggttaaatatgggcagtttcacatgactcaagctgaccgatttcaggtcagtcttctaagtattaccaccctttatgtgcctggcattgagaaatggagaatacccaagaaatgaagtaaatgggctggagcctggggaacttaaactctcttaagaatttatgctcttaattctgtctcttaaggtagacgaggcataaacatgcacaaaaaccctttgaaaacaattatcaatcatacaaagaagctttcatcattttcatctggtgtgtctattctagccaatatgggaattttggacaaaaagacacagagtgtcaaagccttcactcatgtatttattagggctctttggttagaaattagaaaaaccaccttcttcttactgactgacgccaaaaaggagaacattcttacatgaattttacccgggctgcagtcagtttccaaatggaaggcaatgactccaaaattagaggatacatcataaacagtagtcaagtctagttgcccttttatatcattcacaaaattaagtttattaagtaaaatctttaacaatgagcacacacagtaactcttctgtggtagcctccatatatgttagatatgttttttaatatcaaggtagatattttcactctgcttctctagttgcttttattgaaaaagccttttctatactttcatatcatatcatgggaaacatttttcatttttctctcatttaaaaatattctgtctttcctgtttcgttcaggaaacaggaaacaacaggtaacaacagtagcaacctgactccacctaacttccatctctgtcttcccagcttttatatctgctcattctgtgggtagtaatgtaggagttacccaagaaggcgaggatttgcactgaacttaatgaacacctttgtctgaattgtgcatcctagctctgtgatggtacttcgcatcttggcgaatgaataggatcctggaaatcaggaatccacatgttctgtcttcattctcacaagtggttttttttttttttttttcaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggtagggagaggtgtctctgtgcacacacatgcgcctagcggggcctggggctttatgcacgtaacttgacaagtttctgatttcgtagtctcagttctatggatgagggttaagagttgtatgagttgtattgttaacaatctgtttctgacttctttttcaggaattgaaaaaaatgtttctgcacctgtagagatcaccaatctggactggtgggttggctcctcccctcaaacttgcatcagtctgatctaactaaaaccaatatttccagtattttttctgctacgttcatattgccacccatgctaagagaaggatgttttttaagtccttcaaaaatagtaactttttgagtagaataaatagtctgggggcgggggaggaagataggggttgggagtaaactgattgatgctaagataggggtccctgtagtgaaaatataatagcagatctcaaaacctctccaatggatctagaagcttgttgccatttggatcccactattctgtgcagcctgtccctctggctcacacaccttcctttcactgccaagaaatggaatatttcttccctcacagcgagggcaggggcctgtgctctgttagatcaaagcatgtgccatgtttatttctcctcctgcagaaatgacggagcccatttgggcagtctaattgtagttccttcttgttaataggtgttagttcagcaaagggttgacagtcaagagttagtggtgcccagtggtcatggccaaagctctagagttattcagggattcagaaagcaaacaagagtctgtgcaacttccttttttcttcttaactctttcttctcctcaaagagcaacatgggacctaattctctttctaacttctactccagattggtgactctgagatgcagaaatactactgagagattgacatttctcatcagctatgattcccaagattttataatacttataattttaacatggattcagataggattatgtacttcatatatttaattattaagaattaaaattaattccgttgtgatcttttcactatatccctggataattttggaagtgagcatcacacagctggaactgggaatcattaattgctttgtcccatattaggcctttgtgatttattaaagggctggttcattattattattattatcatcattattattttggtcttggagcctttcttccaagttaacacgtgtgtggaagtctaaatgtctgcacagagctgagagatggccgtggtgacagtggagactatgggccccagtccctctccccatccctcgaggagcctctgacacctcagggagccatgggcctcagcctgaaaaccactagtctactaagtggcttttctaagaaatcatttttgctaaataattttttatctcaaatcagatattattttctgatttattttaactatccttttttttcttcattttcctgttctactcttttttcctcttgagttcccggtagtggataccagattagcaaaacagaaggtctgtaatccgtggtagaagttgagaacaatttttggtggtaggtgtggtgtatttgcctgtgtctttctgttctactgtttctcattatgtagcctctgcctcctacctgcttttcacatgctcgttttaaacctttctcctttccctctgggcccctgggcttccacagacaggaagctgccgtactaaagagatagttgctaaggagacattgggagtagtttaatgagttctaactagaaaaccttccactgcataatattgaaagttttttgtttgtttgaaggtaaacagagatattcatgaaatggttgaaccagtatctctacagaatatattttactatctctaaacttggggtgcagaatatagaatttatgactgggattatttcttgaagtaagttgattttcagttgtttcattatgtgcttaaagttaagtgttttgtcatggcagaaggtaaagactgttctaaagagacaaccttcacacaatagccgcatgtctccccactaatattaagtagaattttctctacatgaaaacgtgtatcacctatacatgttatacagttagagaatctacagaacaattgctaattttacccctttcatatttactacccttcgattagaagctaggtgacaaactattttctacacaccttaataaagtcactgagttgtctcgctgatccaggagtaatgttctgcaaaggaaagtatttgactactagaaactttgctctgcagtctggggagtattttagccagatagcattatcatgcgcctacattaccattgctgcgagacatgggaatcgttttaaattttttttagagatagagtctcactctgttgcccaggctggagtgcagtggtgattgtagctcactgccgcctggaactcctgggctcaagcaatcctcccacttcagccttctgagtagctgggactacaggtgtgtgaaaccacacctggtaatttttaaaaaaatttttgtagatccttctgccttggcctcccaaagtgctagacttataggcatgagccaccatgcccagccctgacatgaaaatcttaagcaggccatttattaaaatctttcagtaaataattcaccgagcagctaagccccaaccaaaaaaaaaaaaaaaaaaaaaaaacagaaaaagaccccaaaaagtgacttttctccacactccagggtttcagtgctggcttagaagtcatgttcagccacatttccaaaattcttcagtcccttttgttgggaattaaagggtatgtagaaggaaaaagggtagaaacttgaactatgctatgagatctaatattgaaaatgaaaagtcttgacgtgagaagcctgtgatttcaaatatgaggcctaaagctggttgataaacacaatatgaaaatcagagaccaaaggctgccaggggtatatctgcttaatgtattgcaagaacgtgtgctgtagacgcctggggccaggggaagacatgtgtacagaaggatgaacaacagaaccgcttggtccatttctcctgcctataaaatcctgaaatcctgtttttcaggttgtactccattagctctctttaaaaaaaaaaaacaaaaaacaaaaaaccaacttttaaatttgaggaatatttttactgctaacattctatctcctttaactttttcatcagcacatccggagcccgcagcttgaatgtcacagactgtaatcattattgcaacaataatgaaatacattctttaccacaatttaccactattacatatattacatatttaccactattaatatgttggctgtgattgaaggtgggcgaagggatcttacagtagagacagaccccagctcagatcatgtattgcaatatgtgtttacggtgcctggtatacagcaggcacataataaatgttgagcccaccccttgaaagctggtttaagagtgaatcctttggaccttaaaatgtattttcccatagaaaatacgtcattcgtaatacatggattctgaagcgaacccacagtcactatttatttcattatatgctaggtatacaatgaaataatccacattttctaccttattagtgtacagattcttccttgatgcttacttcttcttcacagtcaccctaggagtaggtacatcccatcataactctctatattttagagatgaggaagtcagatactgtaaaaagttactttagtgattaagaacaaaaccaaaggaatgtgtcttgaaatctttggggttttgcatctttcctgaccctcctcttcctccacctgctccatgcctcagtggtagctctggcaaagccactggtgagttttcctgggggagacgtcatgtaggcaagtctcacactttcccttttagtgatgacattttggagtgtcttttaggtatgctcagatttaccataagcataatgaaaaacttgacttctccctataaatggattacctttctggaggtaccctcgacattcaagaaagtccgagggtttgtttgtttgtttgtttgtttttttggttgtcagtgaacaaactgccttttaaacaattaactcttggcttcttggtgagaagcaaactcaaagccacaaggagttaggcttaaataacctgttggaaagggctgtcagagtacaggattcaaagatgctatcagccgaggatgggaatgaaagagaggagaggatgtcttcgctgtagtagtttgacttgttaactagctctagcaggcttaagtcagttgtggggaccaactctcagagactatttcctaaatgttgactctgcctcatgcagtggatgttttgagaatgcttctggcttcctcaatctctgtagctgatacatttcttgtagccacattgaggccctggcacaggaaagctactcagttcttctcaatctggcccagtcatcttatttctgccattgccctatacatttgaaatcttaaatgttctaaatatcttaaagcaatgaaatagattcaagtgtttctaacttagaaaaagtaaaagagagagcaaaataatacagcttttaaatcacctgtattctatacgaattattttaaaaagaaaatacttcacgtataatcccagcattttgggaggccaaggcgggcggattgcttgcactcaggagttcgagaccagcctgggcagcatggggaaacccagtctctactaaaaacacgaaaattagccgggtgtggtggcacatgtctgtggtcccagctactcgggagactgaggtaggaggattgcttcagcctgggaggcagaggttgcagtgagctgagatcacaccactgcactccagcctgggggacagagcaagaccttgactccaaaaacaaaacaaaacaaaacaaaaacaaaaacaaaaaatccaaacaaaaacaatcctgccgaagtggggcagaaatgagtggaaacttaacaaatgaatgggaaaaaaaaatcgaagttcctttatcgaaaatataatgtattttaactaaagtgttaaattttgaaacagtggaataaaacgtttaaagtgaattttattcccatctttgcggcaaatgcccagggtcccccaaaaaagggcatgctcaagtcccccacagtcgaaatctgctaatccagaatgaaaatggaatcattaggataaaattatcgagtgtgttcaggagcggctatgccagtgaatttccagcctgaaatgaaatcatgacttaggtgtatttatgagtatctgttttaaaaaccactgtgatagctagctatcacctcaaattttgaagtcgtttcgttgagtgtgaaaaaaaggagaagacatttcaaagtgcatttagctatttaaaaaccctttattcactgagtgtgctgctgattattacatgtctgtggaagcttctggagccagtggtggagaggcagatgtgaataatcagtcgagatgtatattgatatgacattatgaaccaacagaggaaatccattaacgacatcatttgctcttcctctggggctcaatttataattatttatgttccaaacaaaacaaaacaaaccctttttgctcttttagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccacgaaatgtcaaatgcaagggtccaccttgagggaaatagatgccaaactaactagaagggaccccggccctttgtgtgtgaattgtttatgcaccagtcatttttcactgtgagttttcgtgacactattttgcaggagcccatggaagtgtgtgagaaggggtcgcaatggagatcactgggagtgaatgttttcagggttttgttttgaagtgtcacagatgcttgtctgatttttttaaccttccgtgatcacaaacaggaatataggcctttgaatctgaagtggacaaaggaaagcaatttccagtctggctggggcacagcattaggtgattgaaaaggtgatgtggacttgtaaaaggtgttactcaaatattgaaggaagagaatttcctccttgtgatacttaggatgaccctatcttactctaatagatacaataattagtttgtttaaaagcaaaatgttctttgtgatacaaatgaagagtagggcctgaggatgttattctttctaatggaaggacataaatctattttatgtagttttaaatagaatgcctaaattaggctgtgggagataatttttagtggttgtaggaaagagcaaatttagggagtgttgaacttcaggccttttattcctgggaagatatgtatagagaaaacttttaaaataatttttgattagaaatatacatgtgcccatgtaataaacaacagaatgtgctcattctgctagtgcggtataatccgaatttgtactcccctaaaatttatcagaataacaattatgcatacatgaactatgccagagtaatgtttacagatactttgtaaccaatttcaggaggcgtttttagctggatgtgtagttaattagaccaacttatttccaaatggtttgttaacattttgctttggtttacaatgtcatgttgaacacaaagaagacccagcagcaaagggatgaccaataatttcatcttatagcaaggagacattccaacgttcccatgttttattttctgagaacagtgggacagatctgtagtaatggaatattatttgcaaaagggttacatatgacacaagtaagtgttctgacataaagttttatttagttcagtggcatgtgctgttgggagccatacaccataaaatatatatatcccaaaataaatctagaatattttcacctccaatttcagtaattggcatatgatttgtgagacgcatctgtttttgtatgaggtttaatcactagcaatctgtttaaagaatccagtcctatacacagttggactcattcttgaaacctttaaatgctccctcatagtttttcagttatttggaagttgcattgggtcaaactgaactccttgagtttggtgtaaattccttttttctgcttattatagtgaaacttcagcatgtttcttagtaaactcccataccattgaaatgcttaagccagttggctttcagtctcatgccttatttcctccaaggcatgcctcaacgcattgtttgtctcattgcttaaatatgtccagaaggaatgatcatgtatctaatagactacatagttggttcccttggggagttatatatcatacagttactaaatatttgtctaaattcattttttccaaaaacctgctctcaaatttttcttctactctcagttcataaataatataaccattgaaacaacacatcagcctctagctgatcctctgaaagtagccattgaaataatcgaatactgtgtgaacaggaaaggaaagcgttacctttaagagaagctttaaaataggaatttattgatatttcacaagatataggtttacagaagacattattcaaataaatatgtacactatttgcctgatgctatggggtacataattttttaaaaactcccttagaccagcagccattagtgtagaaatgatggactttaaaggtgataccatgtaagcagatgttgcatataaaaatattcctgcctgaatctgatcgagattcttgaatgggggaggagtggcagccggcagcacattgcaaatgtcattcgaggtcacggtgaggctctcggtcccggaacagtgggggcctcgccaggcgttgccagtatccctttcctcctgtaaaatcatagctttgtgttacacgactgcttatccagtcttagggtttagcagctgaaaggtttacaaaactgaatctggttgaatctctgtgaaagggtcaacacatctgtcggcattttgcacacttatgtattattatgatacaacatattactttatggtaatttttatttttacatataactacctccataaatttgatgaaatggcagccgtgtgttaaagtgtatcgttcagaagagcaaagttgaacacttccttcaacattagggcatggcgtgctgtgtgtgtcagtgattgcctctgtggactcatgactttccatcgccatggctttctcttacgccgctgtttggctttcagatgtaatcctgtcttctcctctcttccccacgaaagcgcactcgattttgttaggaatgaacggaagtttaaaaattcttgtgcccacccccgccctccacccattcctgttaaaagttctctggcgaagagccaatgggtgaacgtaattgaaagagctatttactcttttggaaatctgatttgaagtctaagttttcagtaacagaagacacacaagcaatgtggactgccaagcttgaagcacttcgggctctgccttcactcgcatgctaccatgtcgagcccaaactccactttaattaaaagagctgtgctgtgaattccacaacttctgttaaataatttgtattccattatatatattttgcacatctcaggggaccataatgaacatatgaaaggggggggggtgccatcaaatagagaaaacaaatagaagaggtgaatggagactagctggataaaaataacaaattacttcttctctgatgttgtgaaggtcaggttcaggaagcatcaattcacagttaatccggagtaacaatgatctgaacaccagctgttcccaggtccctctttttcatagcccaaccagcatctaaaatgtaaatttaaattacattgcagtcaccatggggagaagaaacctgttcagtggaagcagaagcattgttccttttttaggttggcgcagctttgcaaaactctacccaggataaaccacttatcaccaccaagtgtacttgaaaataaagtttttaacttaaattacaagcatattgctcataatacaatagtgatcattttttgaaagtcttgccatttataacatgggcagtatttggagcttcatttaaaaaccaacaacaaccgataatgactttgcacgattcactttgggatctcaaagtgcttccaaagcattcagatttacaaacaattcacaagacaggtcatctttgtaatacgcatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaaaaaaaaaaaagttcagggtgtttggaattttacatctcagcacaccttactggtatcaatggataaagcgggtgattgacagatccacccaaatgccactgcagtcagaagcagatctggacacacccttgtttacagtttcatattgggttgctatagttcccgtgctaaatcaccagctttcaggaacatgactgctcctggcagtggaaggtgctgaaacagaaattttaattaaaaactttatcaagtactcttcacagtgctgcttggcaccatagaaaatcagtacaatatatcgagccctactttggaggagctggatttctgagggagctgatccagttctaagtgtcttctcgaattaggagatagatgatctttgatggggatctcctccgtcaccacaggccagtcacagaaccaactagccacgtgctgccagacctcagtgggcccaagcaggagcaatctcttctatcccccatctcccccaggaccatcccgcccattgtcaacgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggttatatgtcttaagtggattttttttggtacttgagagaaaatattttaggtgaggttaattgacttctctcttcaattaataggattttataacattgtgattactcaatattattagagcttctgagttaaaacaactaaaaatgaaaattttctgatcaaaattctttttccatgaaagttgggggaaaaaaatcacatttttaggtaactgaatttaaaacagagtgagagagatgcctataactacattttctatatgaaattataaagtgatgtgattaggtctggggtttctttttcattagcactcatgtctcagcttttgttcccaagtggatgggatcctctccccagtaaacacgaggaggctgctcacaggttccagtgagtcacttgcacaggttcggaatcctccatgtttattctccttcagctgtcattcattcttctgagtctctcactgtggcaaatctttgcccgtagaaaatgggctttttcaaaccaaagggatttgctgccccgttaatgatggagctaggaaatggtattctcagtcaaaaacaatgagccataaagtcgagcctgattttcttataaaggcaatatccaaagtagacttccaaaaattgttgtgaacaatgacagtgtctacggataagtgtctggagaccccaaggtaactgctttgaagaacaagttgtattttgttgcgtaagtttgtctatatattttaaactgtctcaatacagacgtttcctttttcaggcatgaagttaggaagagcaggaatactgggagtatattgtgagttttactctaggaccaaaagcagctgtggtcaaggaaaggtaattgtgtgttcatttcagaacgatctagtgaactgaggaaacgtggggacttaaggagaagggggaaggcaggattctgattccttggagagaatggtcacagttcataaacacgttgtctttccaaaggaaacggtatggttttaacttacttttagcatttagagtggtggcttttctctccttccttagagaaaattcaagcagagtactcagtacttgcctccttccctggtggtggccatgaaatcgagaaccactgagtaatcagaagaagttattcacctgaccttaataattcatttaactgtaaaatcttatccctactgtgagagttcttggatttagggacacccccctgcccatcttcacgctcagtggctccagacctttcctgtcaagcaaatggttaatcatgtgtgtgattaatatatttgcacagtacattgctccatacaggaatttcaagaaaaaccgaggcacctgtgctcaagagaggccgaataggttgcttaactgcagctcccaaattccatcaaataaattcctcccaggtcactttcctttgcgtttcccttgttcctcaccctttattgtaaagttccatgcattatttttattttctattaccttgagtttattttactttactactcttcactttgcataatagcagtgcttttcatttgttcgttgttatgctgttaatatttggactcactcttgctctccattattgataaccacaattgattactagtattttaaattttacatttatattgtctttccctccttgtgtgcacagaccactgtcatccctcaatctcatttccactctcacctttgcactaagagcctttggttctctgacacttctgtagatgtctgccaccagctgagtcatcagtggcctgataaatggtaacttgaagatatgcatggattgatggatggatggatggatgggtggatggatggatagatggatattgcattagatcaaaggtgcctgtattcttatcgtctgaaaatgacaatgaaacaaaaggagatatcatgcaaaaggatattttttgatgtccgtgtgactcccttttaagaacttatcttgggaaattattttgtaaccttcttctatctatgcttcaagccattgcctgccattctttactatacaatatatgatttattgtgggaaaagtttttttcccctgaaagacacctccttttttttttcttttgagacggagtctcgttctgttgcccaggctgaagtgcaatggcacagtcttggctcactgcaacttctgccttccgggttcaaaagctttcattgagagctgggattagaggcacctgccaccatgcccagctaattgtttttagtagggctggagtttcaccatgttggccaggctggtctcgaactcctgacctcaggtgatccacctgccttggcctccaaaatgctgggattacagacgtgagccactgcacccggccaaacacctcctttaaagttagtaacagctcagtggtttagtgatcagcaggcccatcgacacagtgcagcttcacattgtttgccactgttgataaaacaagcgagacagataactaacaaagctcaagtggattggagaagacagcttttgcccctcttttttccttcatgtgttatttgaaggcagttcatgagaggacatctgtgttgaatgtcaaaggatcaatactcagtctgggaaaatgttaagattgtctggaatacagcagtgagcttggaaacagaaatggtcatttctacatttctctcccttccatgtctcatctcttaatttgaaggggacttaattaagtggattggggctccatatggcccctaagaagtcagacaaatgagcataatagaaggtatcttttacaattgactcttgctctagccaactggtggaagggccagcactttagaaagacttgcctcgggacttcagcagttagcatttttgtagagagtttttgagagtaaagcacttccactgcatcttaaaaataaacctttgataacatttttagatttctggaattattacaaagatagtacagagagttcttggataccctatatccaatttcccttgttattatcatttcacattaatacagttccttagttacaattaatgaaccaatattattacattattgttaagtaaagttcaccttttattcaaattttctgtttgtccccactgtcattttttgttgctcttgtcccaggagcccaaccaggataccatactataatcagttgtcctgcctccttggtctgtgacaatttcttaaactctgtttatatttgatgtccttgacagttttgaggagtatgtgtctggtattttgtacaatgtccccagtttgagtatgacttatacttttgtcatgagtaggccagagttatgtgttttggagaggaggaccacagagataaagctccattctcatcatatcaagagtccatcctattcattatgacctattaccactattgatgttaaccttgatcatctggctggaggtagtggttgtcaggtttcttcaccgtgaagttactcttttttcctctctttccatactgttccctttggaagaaagtcaccatgtgcagcttaaggagtggagagttaagctctgcttccttaagggcagagtatctaaataaataagttgtaattcttctgtacagaagatttgtctcttctgtgccacttatttatttattcaatcattcttagcagtatagattcagatatttatgttatactttgggtgagagtctattaccactttattttattgctcaaacttttccagattttgcactgagagctccttaagttggctcttgtacctctttgatgtaccccagcactgtggtttgttcacatgtttttgagcaccttcttaactctctggcactataagaagctgtaggctcattttgtatatttcctgtcccagtcttggaatgagtcgtttctctaaagaacgctcgtgtcttttattggagaatggtattagaaaccaccatctgggtgctggctttgtgcattactactggggagacattacttctaggtcttctcagctgacagagcaaggaggtatatgtgtgtatgctaacctgtccacatacacgtatcaatagatattgctaaatgtaaccacctgtacttctattaagctaagtgtcatgctgatgtctccaactctaatgcattatgacatggatcattctagcctcttttcttgctcatctgtaacttcccactcccacagtgagaaacccggctctcatcacctgccatccctttactggactgctcaattgcagtatacacgatagtaggtcatccattgcattttctaaaactgatttgataaatatggaaatagggaaacaaatgaaagtgtttctcaacttattctagtatgcggcttacttcctgtgacagtgcagtgaagattataaacttgttagtgagcttatttggtcctagaaggattgttctgaagaatgtgaggttcagagggaggaggggcactattaattttatttaagatgtgtacttccttatgctgcactgttagaacttggaaagaagcgacgttgacttagcagtacagactaaatgtctggtgaaccgctacttccttctccccacttctaatctctgaatattgacctaaatttttaccatatttcaaggtccagatcaaatgctgtctctttcacaaggccttctctgagtgcccttctccacttccatgccctgagaagatggcttcttttcctctcttatagtacagcattcatcatttccaatcctgtgttctcatgttttgccttaaagacagaccctgcccaagaccatcccctcagctagacagtttataccactttaatattattcccttgatttcctggctgggggagcctctgcttgtcattgtttctaggtggcccttatgagctttgaaatcttcagcaagaaatgggctgggtgtggtggcttcaagcagggtttgaaaaacgctgcgtgctgtggtcagggctccttctcactaagaaacctctcaggaatgtgctcccagctactgcatcctttttgcttccatgcgtctaccttatcaccaaaaaacctcaacacaaaccgaaaccaaagaacaccgggaacaggaactgagctttggcttttgagatgtcgagaagttgttataagatgagaagctgagcgggaggcttccagcccttcctgttgcaagcacctgtgctgcagaagcctggccctttgctcttgggttgtgacggagccgctgtgtttctccacagcacccttcagtctgtgtgtgcagcaccaagtcggggggaagttagaagaggtgggaagagccaccgagcaggcagctcaggagaagccaaaccttgcacagtggaacggaacgggcagtccatttgtggggaaaacacgagacggaggtccagtgctctgtggtgcggcaggcaagggggaggctcttccccaaagtggttggagtgtgtatggccacggtcacagtgtgtttccttttaaccgtatcttaaatctgaaggcagctgacgattgtttatgcaaactttccataaaagtgtaacaaaaaatttattttctccgtcctgatttaagttttctccccactccatcccccatctcagccacatggtttccttggggctgcttgtcatttttttcccccacctcctgctccttctctttgcatctgtgggattttgcttgcagctaatttttcattttaatgttctcatttctctccccctgtcccgcacactttgagaacaagtccatgaatttgatttcttgataactttttcatatcttcccagagcagtttccccaactgttactaactcattttgtagtcataatgtggctgtttgtaaagcctcactagggaggtctgctataatatataccaacacactgcttgctcttacttccaaatattcaagctggttttaaaaaaaaaaaaagccggaatctctgctcgtctttttctggttgtctgatgtaataccagaaatctcctaagcctctggtttacctgaggtgtttggagttggtgtatttgaggggaattgctaaaatgaagttgtttcttgtggcaccaaggttcagacaactagggctgggttgcagcccaaggtgaactgaatgactataaagtcaagttcccactgggagatgtaaccttacaggtaaattgaacaggggcttccaaatccacacttcttgaaagccttgcctctatgaaaatactcatcttaattttagttgtctgtatgtcccaatttttctacagtaagcacatattattctaaactcagaaaactgtgtatggacaactaaaatgtttaagaatacaataaacagaaggggctggggtgtggtggctcgcgcctgtaatcccagtattttgggaggctgaggcgggcggatcacttgaggtcaggagtttgagaccaacctgtccaacatggtaaaaccctgtctccactaaaaatacaaaaattagccaggcgtggtggcacatgcctgtaatcccagctacttgggaggctgaggcaggagaatcactttaacccaggagacggaggttgcagtgaaccaagatcgcgctactgcactccagtctgtgcaacagagcaagaatccgtctttttttttttttttttaaaaagacaataaacagaaggtcacaagttgtgactcccatgtcttccctctttcgacactcttgagctcagctgtcttctggttggcgagtgcttcctttctccgcagcgtcttctggccacttcactctgactgaggctgaattttgaagcttacagatttctcgtgagtataaaaagccttattaattttttcgagctgtaaatcaatgtacctcctgctagccagagaaaaaatattgttctcgtctcaataaagtgcaatccagaatttcttttttattttttaattttttttttaatttttaatttttatttttttgagacagagtcttgctctgtcgcccaggctggagtgcagtggcacaatcctggctctctgcaacctccatctcctgagttcaagtgattctcctgcctcaggctcccgagtagctgggattacaggcatgcaccaccatgcccggctaattttgtatttttaatagagatgttggtcaggctggtctcaaactcccgatctcaggtgatctgcctgcctcagcctcccaaagtgctgggattacaggtgtgagccactgcgcccagcccagaatttcatactatgaagtaggattaagaggggaaaactctcaggagtaaagattaagtgtcatttcttccttggggcacagagtaaaagccatcatgtagcaaagacaaatgaattatttgtagccggtgtaagctggtgcttgattttttttttttttttttcaatagagataaggtcttgctctgctgcccaggctgggctggaactcctgggctgaagcaatcctcctgacttgacctgccaagtagctgagactacaggcatgtgccactgtgcctggcttattcttcttagtccttacttgagtatttagacattcttcccaaatgctttgtcacaactaactcatttcccctcaaaatccaagtgagaatcttcagacacttcctataggcccagatatctagggcttgtcaattaatgttgtaattaattaatttttatcataatttgtaaaaaaaatgcatctaaatcacagacttaaaaaatgtcacccccaaaaggtagttcattttggggaatgcttttttaaaaatgtggggtctccttgttataaactaggtttttgcaaaggtatatgaaaaagtgaggtttgaatttgatagtgccttgaatactgctcttccagattgagaaattaataatacactgtttgaggaaggaacccacatcaatagaaagaggacatacaagtgcacctgcatgtattctgatgtttggatatgaatgttgatatagtggatagtttacccagcaagtattcagtgctttcctccttgcttctgagcatccctgaagttctagggacacaaagtaaaagacatgatcgttgccttctaggggattcagaagggaaggtcacccccgcacatggaagagcagtgatgcgcccatactgcaacgtgctcgggatactgcgggaaagggttccagaaccattccgcctactcaccagctctaggatttggcagccaacaccctcctctgacctccgaggctcggcgttattgactaaccctaacagggatggatcccgccttccctgcctcacagtgacttctgtgagggttaaacgagagccatgaaaaccatgcatgtcaggtaaggtgcaaaaccaccattgtgcggttgtgcaggttcgggggagacagagctcactttgcgatattttattactggagtctaagctggacctctaaagcagggtgggatattggtaaggacaaaggggtttggagagtgttccgagcatggatgacaagggcttaaactcaggagcaacaaagataacagttgcaagacagaggacataggatggaccttcctctcaaagcaatgcgtagcgtcataaatgctctacgtgtatacgagggggaaacgggtgaacatcacaaatatcattttcccaacacagttttgctatagaacatgaaaggtgagcactggaatgtgacgtggtagaggtttgtcacatgttattgcctcatgccttgtctgcaaatggagccactacccccacccccagctttcaatgactaattcctacttcaataggagccctctgtcttggctcattcccctccagtcttttctctctctctctctttccttctctctctctctctttccttccttcctttctctctctctttctctctctctctccttctctccttctctctttctttctttccccactccctccctccctccctcccttccttcttcattcttttttctttctttctttttatagaggtagagtctcactctgttgcccaggcaggaatgcaccagcatgatcacagctcactgcagcctcaaacccctgggctgtggccatcctcccgcctcagccttctggccccttcagtcattttagcactctcgtgttctttgctttcccccgtggacatgttgtgtgtccccagctggatttcagagtccccgaagtcaggaatgcctctcagtcctgtgacctcacagagcctgcagtggctggctctggtgggtatcgctggtctgatgctgacaagctggctttccctcttatgtttacttggccctaaccctgacagccacccacttgcagttcttttggtgagtttcaaagtgtccttcacaaagtaatgtgcccgcacttggctagagaaaaggccaaatgtattttaaggcttctgcaatacctgtagttttgggtccagccactctaccacagtcgtgagtgtaaagatgacatgatcttactatgttttatgtgtgttttggcatgattaaatagcagcattagaacatgaacctcaaaaatcacacctttctgatgtttctcttactttttttggctctcccttctaaggccctgtgcccaccccttgaatgatcaatgtcccttaaggatttttgggccccttttcttcttgttcctgggcctctacttgaattttctttctgtctttttttttttttttcctttctgtgaggaacggggtctcgctatattccccaggcaggtctggaactcctgggctcaagctatcctcccgcctcagcctccctaagagctgggattacaggcgtaagccaccgcgcccggcacttgaattttcctgtaaaagaattcagtatcttaatcttcagcccacacttcctccctgagttccagactggacatctctgtttcttcacagccagtatttccagcgaaacttgcatctttcccatcagaacttggtcttcctttctgtgtccccagcctcgccaaagatctcattggctacccacttgctaaagccaccaactcaggagcgcccctcggccccttcctcactccctcgcatcccacatggaatccatcaccaggtggtcttcgtttatctcctaagagtctcctgagtcagcccacttatctccagctccaccaccaccactgtgctagttcagctcacccttacgtctcgcctaattatttcagtggcctcttccttgatgtcctgcctcattttcaccacactgtcactggaggcatctttctaacatacaagtctaactgtgttactccccggcttggatccttttggtggccaaagttagttcagttagatccaagtcttcactaaggcttgtcaaaccccccaccccaagtcccgcctgctgactccaccctatcccccaaggctggcatccccgtgctccagccaggcctctgctcaggctcttcgctgcctccatcacctcaaagaccctcagcagaactggaacagcctttcctgccttcactggccccatcatggcgcctgttcactactcaatctttaggtttcatggacctgggctgcaagatatttgtctgagcttgaagaccctggagaagaggctcttgtatggctcccttggcccctacagctcagagctggggatttcctgtcatgcctgggtctttggggtgagacttttaggtgaagatgtgtgcaggggggcatgtccagagcaatagttctcatcagtgcatggcgtgggggcgtgaatcagtcactggagaaatatttccaaagtatgcatggttggcctccaaggagaccctcatcctctcaagattccgattcgggaaatccacagtggggcccaggtgtgcatattttaacaaagttccctaagattgagtctgttttctcttccctgaccctttccaagaaaagaagaggcttaaagcttggtggtgatttctgaaattggtcttcaggaatcagggcacacttttcactttttttctgccttctcagacataatcctaaaaagcgagacaggaagttgtgtcacagccaggctaggaggtctcagattgaagacaattctgtagagacgtcctgtacagcaactaacattctccaaggagctgaaatcttaacaaaaaatttttttcctacaatttcaagtctcctatttaaactgacaacttcatccttaggtaactgtagtgaccatctggaggttttaaggtttgtactacatgtgaataatatgctggccccagcactcccctctaccagcacagatcccaggaacggttgcttctggcttcagtgtcacgttcaccctttgaaatgtaccttctctagggagagaacaccgtagccaagggtacccccttcgcaaacatgggaagcaggtgaatttatctggagccacttttctattctctgtccatcaattctgtctcctgtacaggagaaaaacagtaactgtctccaaaagttctcttctctaaaggtatatgtcttataaaagaaccttcggtagaaggatgctggtgaactcggccttccacatagtttcacagtagtctgtttgtgtgtctttctgccctgttagtgtggggctttttgagcagagaggctgtgccttcgtcatctttgtatcttctgtgctgacacagacataggtgtttgttgaatgactgaatgaatgaatgaattcacgcattcatgtatgcatgagagcggcagaaggaattataggcgtttggggtagggtggccttcagcaaagtcccacagatccatatagtcacctatatggtaccggtatattattagggaggcattcttatcagtattcctagggaggcattattatcagtaatttttaaacaaagtaattaatatttgaaaaatatacaaatatacaaatatgtgatagaacatatttgtatatttgaaaaataacgagtgaaattaaaattttcataatattagaatttaatacaattagccctctgtatctgcagcttccacatttgtggattcaaccatctgtggattgaaaatattgggaatatcaatacccacagcaataccaatatcaatattaataacaaataacaatgcaacaataaaaaatacaaataaaaatccaatccagtataacaactctttccgtagtatttacattgtattatgtattatgagtgaactgtttaatagaggtgatttgaagtagacaagggcctgtgtgtgggttatatgcaaatactgtgccattttatatcaaggacttgagcattgaattttggtattttcagggggtcctggaaccattccccctaagatgttgaggggcagctgtacaaatttatcctgaaatgtctctagtcttcactttgaactgcagacaccttgtgccaccttatcactgaattctgtgtagcctgaaagattccaaaacacacagatattcacacacgccaacaatacaggggcagtgttagacaaatggggtgaagaattggggagctattcataggtggagaacagataaatatttggaacatctggtcttataaaaccatttattatttttttgagacagagtttcgctcttgttgcccaccctggggtgcaatggcataatctcggctcaccacaacctccgccttccaggttcaagtgattcttctgcctcagcctcccaagtagctgggattacaggcataagccaccacacctggctacttttgtatttttagtagagactgggtttatctatgttggtcaggctggtctcgaaatcctgacctcaggtgatccacctgcctcagcctcccaaagtgctgggattataggcatgagccaccgcacccggccttattattatttttattaaaaactatgtttattataagaaaactgagaattacaagaaagtagaaaacaagcgaacaagaattaaccatcattatatcaaccaaagatgatcattttcaatataatgtgtttattttatatatatatatacatgtatattagactgtatggtcccaattttgtttaaaatatatttttaaaaaattgggaccatacagtctaaactgttttgtaacctgcctttttcccatagttatccttaacatttttcatggctttaaacattcatccacattgctccaaatggctgcatagtgatgccttccttaaatcattttccttctgtttctcattgttggatattttcaaaaacattttttctgatgtgaatgttcaggccgtcacaaacatccctgaagaaacctgaacatgtcctggaattagaattgctaggtctgtagttctccccatgtttaaggcttctgaaaagacatcgtcaagttacccttcattgtttgtcgtgtccagttacatcctggtcagcagttattctaaaactattttccaacacatgtaatggtcacttttattttggaacctttacaactgcatccattactgtaggatttgcatttcaggattacatactgatgtataattttcctgcaaaattattctgcgtggttgagtctttaccaggtaaagtatcatatctcctaattaagttttaataaaacagtattatgataggggatttcttggcttttgcatctctgaaagtccaccaggggaagccaaattagtcattgctaatcagaaatattttgagagaaagtaactgtttcactgtaaaactttttcacctggatggctgggaacagcatattcaaattcaaaattctttctgctctcttgctctcaagtatgcaagcacaatgcaagtatgatttggtctccagcttggtagagaaacatttacaacacaacccatatattttcatcctggttgtatgggttgaataaaaagcatctctaattcccatgaagattcaacctctggtataagatgtttttcattttaacccagagtgaaagctgcacagaaactacttgactgtattcttctgttagtaacattagattcccaagatgcaacaggctttcagatgtattattctcctacaatgaagaaactcaaggatacgaaaacctggaagagcttttcatttgacatcttcctttcaaggtaacagttgtgctgcagtttgtttagtgtgcaccagcttattagtggtagctttgtgtgaaaatgtggttatcacaaaaaggtaatatatggtgaagagcagctgctcctaatcacaaaccatccataaatagctttccctccttgagaagacgctcaattctctggttgtcacagtcagcagaaaatgaaaaccccataggatgataaatagtttaaaacatatttctccccagtgttttgaatgctgtcttataatgcagtgcacttttactgaaccagaaattgtctgtaataaaagaatattgggagaaaatgtttagattctcactgaattctagaacttcgaaggaatgttctggtttcactgttaaaggttaattgctgagtatatgtcataggctgcaataaaatgagagtttttagtcttctgctcccaataaacagttacagtttttaacacatcaaagttggagacctttttttcttaattaacataacagccaagtgaatttcttggcaataagcaaatgattgcttttaaaaatcctataaatatttcattttttaagtcatcaaaaagaaaacaaatcacttctgtcagctgtcttttgacacaaaaccatctttcccgtatacacacagaaaaaatattgttcttgatctttatgctgatgccttttctggctattaatcatctgttttatacatgatattgaccattccctggaggcactcagaacttgcagcttcccttccttatgaaaggaaattgaggagagtcacggaaataatttcagaattttctcaagactgttgagactaaattctaaatgattgaaccatggtagtaaattcattgtcaggtcgaggctgtgacttttcttatttttgtttcaaaaaaattttttttttttttgagatggagtcttgctctgttgccaggctggagtgcagtggtgcgatcttggctcactgcaacctccagctccctggtttgaacgattctcctgcctcagcctcgcgagtagctgggattacaggcacatgccaccaagcccagctaattttttttttatttttagtagagatggggtttcaccatgttggccaggatggtctcgatctcctgacctcatcatccgcccaccacagcctcccaaagtgctgggattatagtcgtgagccaccacgcccgttcaaagctgtgattttttctacttgaagccactggtttccaccagaggttaattgactgtcagtctttcctgtaggtgactcttccaactattagcaataatcagtatctacagaggagaatctcagttgtaagtggcttgactgagtctagcaaatgaaactttgttcttgccctagctgactgatgtctcaaaagtccttgaaattttctattcattccagtgtatgcacaaaacaaagaaaaagtgagcttgttttccacagcccgaatcttcccagagcagatggggcttgcgtttcgcagggtggggggtgtcctgaggactcccaccttgacattgcaatgaaaactttctctcgaatctctgaattctcttatctggcacaataaatgagaaaagcctgcctgcttcccttggtaggcttaaagagtgctctcatgttagatgaatatccagaaatcatctcttctctggcatagcagaaggcacatggtgggtcccagatgtttcttcaagcctgtcattcccagacataatagattacatcagggaagccagcaggaaggaagggagcgctgcctttctctctctttctttcctccctccctcctcgtcgctttctccctctgtctctctcatcccccaagcccaccccaccttttctttcttttctaaaggttccaggggagttgaaggttgactcagaacctccctttatgaaaaaacctgcccacatttcagtaactacagctggtgttaaaagactttggttggttagaaaaatttcagatgtcacaagcttggacagcacgtgggaacgtggaggggacggtggcatgagggcacctcagcagtgtccccttggccgcctctggccttccccttggatgagcctcctgcagttctgttttggagacaagagcttcctatgcggtttcttcctccttgactgaaaatcactgggaaagctaacagagcaccctagaaaactccagaaactttctaactgcctaaggcaaagtgaccttaaccctaaatgaccctcccttatttctccagtactgtgctacatttcatagattagggttagtgacctttgaatgagttcacccgcgtgatttcacagatgaggggcctcagattcatgacagcacatggtccctactcgtggtaggaagccaatgagggcagcccaggctgcagacgcgaattgaacggaagcgtgtgtgcagcggcgtgtgggtggtaagctctccctccactgcgctttcaggctgtccacagacctcaccaaaccccgcggggctgggagcagccgcgcgcaatccgctcttgggagccctgggagctggctgtgcccctgtagcatcggattccacaagactaattaagaacctgggcgggagggagagagaagctgtgcgcttcctgcagcgatggagtgtagaaaatgcttttttctaactgcagtgctgtctcattgctctccagccgcggtccacctggggcatgctggagctgatctttctcaagttatttcccaagtaaaaggagagaacagagagaacagcaagggctcctcctgtgtggctttgctgcggtgggcttggctcctcaaaactgtaaacgctgccctcctcttccgtgacttcccctctgccggtgggggtgttagacgcacctggggagtcgctcccacccatattgggtgtaatcccactgaaggatcggggccctgagggagaagggaggaatttacaaagactcctcatatccctctctttttttcttttttaattttgtagaggtggagtctccttatgttgtccaggctggtcttgaacacctggcgccaagtgatcttcctacttcagtctcccaaagcactgatagccctctcttccaaccagccaccttttgctcatgacctatttgatcctggtctactggggcagaatgtaaattgagacttttgagtccttttctaagcagcctttcagagctgggaaagaactgcgccatctccttgatccgttcccatcaatcactctcctgtcccatgcgtggaatggacatggagtccccgcgtgagctcagtactggtagagagatgccttccatatctcactgcttttaatcattttggccactttataagaacaacataagatggttagcatccttcccttttcaagaagaggaaatttgggcttggaggtcggttgtgttgtcaaaagtcatatggttggtggacagcagagttaggagttacacactagccaggctcatgccacaacctgaatggctggagacgccacgctgccttgtgtactttcacatcaacagaaagcccctcgttttgtatcctatttatatgactgtatcagttacaaacattatgattctactgtctttggcatgtagcatgccaaaccaagctcatacggagccataatggaatgtgtccacagactgaccacagtgttgctttacagaagacagacttcagagcaaaataaactccacaaagcgtgctgaatgggttcctatgacgcgcagccataaggaagtttctttttaaaacaaagttaacttttttcctgtttataagaataatgcacaaccatcgggaaaaaaaactaggaaaatataacggaaaaattttaaaaccacccatagtgttaacgttaagctgtatgtagtttcaattgtacatatatacattttaataaatcagactaattatatatggccttttaaaaaactgtaacattgtccctgaccatatggccaaccattagctactccatgaatcaaagcaggaccttagtccagaccatctattctgtaggcaaagtactgccccctgggaggattttcctcccccatgttcagggttaccatgaagtggggctataatgacttcaatactccgcttggggctggttctggcatatggtacagagccatcagtacatttggcttcagttgttttcctcttttgtcagtaggtcatcaggaatttaccatgaggccatgggaagaggtggagagcatgttgtcagtgtggccagggcagcatcctgggctcctgagcacatgtgacttattgatgcctttgtgagctgtagatatcatctgtccctaatggtggagcacttcttggaatttccaactttatgaccaagtagatcttataacactcagttcatgaatgatgagtattgggtgtcttgtcacctggtgtcacctggtcagccatctccaccaggatctcgtggcaagccgggaagtgttactcttagaaggagaagaggtatttgttggaggcagagttttactcatacattttaaggtctttcactgtctttaaagaactttttttgtgtgtgtaaggtacacataacataaaatttactatcctaaccatttttaagtgtgtcgttcagtggtattaaggacatttataatattgtgcaaatatcactgccatccatttccagagctcttttcatcttgcaaaactgaaactctatacttactaaaaaataactcgccattctccactcctcccagctcctggcaaagtagaccagcatgctactttgtgtgtctatgaatttaactactccaaatacttcatatgaatggaatcatacagtttagtattttccttttgcaactggtgtatttcacttagcataatgtcttcacagttcacccgtgttgtagcatgtgtaagaatgtccttccttttgaagtctgaataatattgtattgtgtgtatatactacattatgtttacccatttgcctatcaatggacacttatgttgcttccacattgtagctattgcgaataatgctgctatgaacatgggtgtgcaaatatctcttcaagaccctgctttcagttcttttgagcatatatccagaagtggaatggctagatcatatggtagttatatttttaattttttgaggggaaatcttactgtttccacagtgactgtgccattttacattgtcaccaccagtgaacaaggattccgatttccccacatccttggccaaacttgtacttttttgttttttgttttttgtttttttggtagtaaccataccagtgggtgtgaggtggtatctcatggttgatttgcatttccctaatgatgagtgatttggagtgtcttttcctgtgcgtattggccatttgtatatcttcttagaagacacgtctattcaagtcctttgcccatttttgaatcaggttttcctttgttgttgaaggtctttcacctttgatgctcctgtggaagcttgcagtaggttccagacagtctcctgatgtgctctaggtccttcgagcactgcttgttcgtagcactgactctagagtcctgaggttctagcaacatctattggtctgcaactctgagcagcataagaactgtgctgcgggagaaaaacatgctgtaaagagcattgctggctccatttgttccattcccatcatccactctcccttcccacacatggaatggacatggagtccccaccgtgagctcagtactggcagagagatcccttccacatctcaacacttctcatcattttggtcactttataaggacaacataagatggttggcctcctccccttttcaagaagaggtaatttgggcttgaaggtcaaacttctggcccaattctcacttaaagcccgcagctgttcacagcacagaaattttgtcgctttattacactttaagtttttctgtatttttcacaaatcaaggttgagattatgcattatcttctgatttccccaaaataggaaatgaataatttaactcacttatatgtccccatctattacaacatttcttcctttaccagttgtccagactttgttaattaaaatccagtttattgttttttacatttttttacatcatgtatcttctctatctctgagaaatctaaatttcatttgcttctacttatgtggaatgattttttgagatttaacactatcttaattggttataatgacaatggtcagttcttgtatgcaccattcattgatactagaactggaattagaattccccttcaagtctattggaatgcttcttcaaataattttttaagaaagagacatagatgatattttctgagcctttgtatgtaccagaccatttttcggatgccttcacaaaagaaaaataactgaggataaaaattataagtatattactccaacttctataattattattttatttcttctggtttgtagtatgacagaaaaaaaagtctaagtccactagtccaggttgatttttgttcacttttaaggaaacttttatgagggaacttcttttttgtactacgtatgtttagaatttttttgttgtttgttggaagacttttacaaacattttaatctttttaaaaaataatttcaaacttacgaaaaagctgtaagaataatatgagtacaaagaacacccatgtgcactttgcccagattcacctgtggctaacacttggccttgctcgtcttagtttctctctctctctctctctctctctccctctctgtttgtctctctctgcctgtctccctctctctccctgtctttccattcacagacacccccaactttttctgaactatttgaaggtaagttagatacataatggccctttgttcctgaatactttggtgtgtgttttctaagacaaaggagagtatattttcagttttagtaaatttaatattggaaaagtattttttatctaagctaaccacccattttccagttgtgtcagttgatccaataatgctctttatagcatgttttctcccttagcgtagtgtctagtctagagtcacatagtctgtgtatttgctgtgtgtctttagcctcctacaatctggactgttaccacagccttgtgtgtgtgtgtgtatgtgtgtgtgtgtgtgtgtgtgtgtttttaatcacatctacatattctgaagaatgcagcccccttctcctttttttagtggaacattcctcattttggctttgtctgatgcttcctcatggttagattcatgacacattcttggctggaatgctacataggtgatgtgccctccttagggcatctcgtttagaggcatatgatatccatctgcccttcacggttcattcagctgatcttctgtatttggacacttaggtagttcccagtgtttccaatcacaaatactatcacaatgaataacttttcatattgttggaggtatgttttcagggtaaattctctgagttgaagggtaaatgaatacgtagtttagttagatatttccagcttttgcaattcccttcataggaattgtaccattttgcattcccaacagcggtgtgtgaaaagtgcctgtttcttcatagagttgccaacagagtacatcttttcatatgcttgagtcatgtttaatcattttatgaattgcctattcatgtcttttgcccactttctatatgattttgggctttctccctcaatttataaaagttgtttgtttctttaaaatattggctctagctgagataaatattgcaaatattctttcctagattgtcatttatctttgcttattttttgtcatttaaaagtattttctttttatgtagtcaaatttatcaatctttttctcattacatgtttagagagtttctcccaaaaaccaggttatggacgaatttactcatattttcctaagatacttctagagttaaatatatatatttttacctttggatctctgatctatttggattttattcttatgtagcatgtgaggaatggatctctttatttttagcctttcaagtcactgtgttcaggtatatctcttttttacattgaagtgttggattttgtttataagtcaatttaaaaatatttttcacgtaataggtgacttaagccatttattgaaatccccatcagtttttggttggacgaagttcatcttctgatagattcatcagaaagggcacatgtatatagcattccctgatccctggcacttttaaaactttttctcttgccttttacctgaaagacaacttgtttagatataatgtccttttttttttttaactttctttacatttcttgaaaatcctgcaccatagttgccttgtgttgtggaagtctgatgccagtctagttctcttgcgttttcagttactttatctttttgcttagaggccctgagaatattttccttatctttaaaatcagatattatcattttactaggatatattttagagtggatcattctgtgtcaatttttcctagtaccaggtggactttttaaatgtgtagattcaattcttcttgtatttctggacatttttcttggattatcgttttaaatattagttctgtttccttgttttgattttcttttgcattgttgccaattatatgtatgttatacctgctttgcctctcttccatttcaatcactttttcttaaacttctttttgtttttgtttttttctttatcctgctttcattctcttggctttttcttgctcttcttcagtgttttttatttggttatcctttgaatatattctttttatcctttattcaaaggatttttttaattcttttttattttttatttttttattcttttattctttttttattcttttatttggttatcctttgagtatattctttttatcctttattcaaaggatttttttattcttttttattttttatttatttatttttttattctttttttttcctttgaatatattcttaccttgacacattgaaattcagttttcagttctgatataatactgtcttgctattttttcctgggataaatccttattttatttcttctgggttttttgttggtttgttttggctatttctctttttagcttttatattcttaattgggttgattttaatatcccagatgcttgtttgaagatatttagttctgtttggagtgttatgttacaattttctttagcttcatatttagatttttggaggatattttttataaacagaagagccttagtgaacttgttctgtcttatataatacttttatatgaatgtggctgcattttcctattcctattcttttcatgggcagagattgtagttcaccatcactctctcctgtcagttctcatctctgctgtgtagtttcttttagagatgaagttggtggtggtaggtcaggctggggagaagtgttgaaatttcttatgtttcattaccacatggtatcttattatttatttccttcacttcctcatgtatttgattataacctggaagctgtcctgctctgattctgctctaattctgctcttttcaggccaattctctgtagcaagagctgagaactatctgattgtgatctcagtttagtatgttgacatgtattatttcactttctctctctgggagtgatcttatctgtacttcatctaaattctttactaccacctactgtttttcacagacttttaagcctctcctctcctgtttgccatacccacaggcttgcagtggcaggtgggtagtcagggctttgttggagtttttaaaaatctctttacaagtaatttgaaggtcatgggattctcttcctctttataatactgaaagcatgagtactagtggtgtattcgctttctttgttaattttatgttttggttatgttgcattgtgtttttctgggagggtatgggaggagatgtggaattggctgccattttcctcaaaacttagaactctccataggtgtaggtatctttttataaattatgcatgaaatatagtgagcttttacaatttttatgcctagatttttttttactccagaaatttttatttatcctttgatagttgattgtttcagttaaaaaaaaaaatctacaaagaactagaatctttgttcttcgtatccaccatctgcctcaggtatcgtatatgctgccttgggtaatatttctctgggtttctttttgtctctctcataccatctctttgttattcagttttattttttaggtttccttgactctttccaattaccctattgaattttttcatcttggctctcatatttttatgaggccttttattttgtttcctacccattcctttgtcaaaacatcctgattccattttatacatgcaatatcttctttaatttctttgagaatatcatagtttttgtgttttaattctttcctgcttcctacattaacccttccttttgagatcatgtttcctgtctgcttatcatgaattctcttttttatatttttttattgatcctaggttgctcattcatatttaagagtaaggttcagccaggcatggtggttcacacctgcaatcccagcactttgggaggctgaggtgggtggatcgcttgagcccaggagtttgaggccagcctgggtgacatggagagacccacctattaaaaaaagaaaaaaaaaagaagaagaagattctaaaattagatcaggagcttcgtatgtttttgtatgtgtgggtagggttgtgttttaggatgatcagccaggaaggcagttgttacactgggaattcatcaaaaccctgaatgtgaaggtcttttggggggcaaggggtagtgggtggatatttaatttccaaaagtgaaaccttttatttgttagcttcagaagcacaaatgcttaggtaacagcattctgtgtaataggccagggacattgattccttaatttatttatctttaaaaaatccatttgttttcagccttaaatttcacttgcacttttgccacaccaaagtatccggttcctagggctctgaggagtcctgaaggaccagctaccactccctgtgatccagatacccccagtgagcactatgctgcctcctcctccaccttatatatgtcattcctcacttctccactggctttctgccttattgttgaaatttttgttgaaatcactcatcggcagatagctactctctagtctctttgacattgtagattaatatattttttaatctttcattatccttgcattttgatggtgtctcaagagggagaagattttctctttttgctatggacttaacctttcaatttattaatttttctcaactgcaaaatgatcatttctaaggtcacctatcatttttaaatcctgttatacatctctcccctacttgtgggttcaccttaaatcccaaaactcatgactttcatgagttttcagcatgtttcctgagacttgatcttagtgaaaatttaactttttttctctaaaggggctgatttgttttaacctgataaatgatctccttagagttgctttggaaaagcattaacacattattattattattattattattattattattattattattttgagatggagtctcactctgttgcccagctggagtgcagtggcatgatctcagctcactgcaacctccacctcccaggttcaagcgattctgctgcctcagcctctcgagtagctgggactacaaacgcccgccaccacgcctggctaatttttgtatttttagtagagacggggtttcaccatgttgaccaggctgatctggaacccctgacctcaggtgatccgcccacctcggcctcccaaagtgctaggattacaggcatgagccaccgtgcccggccagcatgaacaattattaaataaactaccctctgtctctcacctgggccagcctgcatgtagttgctcacgtggcacattgcttgaaagcaactcagtatgggcaggtaggagtgtttgcccttgcgacttgcagtttaggcctcatgtccaaaatgactcaggttttctccgtccatcacatctcaatatttgcacaacacctctctccatttttggttctatgagtcttatatactcgagtttgggctgttctggacaatgactacccatcctgttgaaatttcctttggcacttttccaaagtgagtttcgaccatgccactaattctatatgaaagtcagataactccaagtttggtgaagacctgtccagatattttgcgtgatgcagattgaatttttatttttgttttgctttactttcggttatgttgatcgataccgtttaaaaccaagttaaagtagcacagtgtatgtctacatcagatgattttcttcatgattcagtaatactgagaataaaaatagccaacacagaaagttctttctatatatgccaggcgctggtctagggaatttgcattaatttattcctttcatcctcacacagccacgtgggatagttactattataatcttcattgtaaagataaggaaagtggaaccagggtgcaaacccagattgtctgactccagaaggaattttttgtggaaactttttcttttggaaatggtccagaaaatacctagtccttggaagagagataaaccttggagttactggggtggggaaacatgaagaagatgaatagctcatctagaaatgagaagatgaagcagttcattgggattcgtaagagtcttgtaggaagaaccagctagaggaaaccatgagaacggatatctgaggagacggggccttcttactgttagaagctctacggtggcacagacgtgtccacattcctctatgtcctatattaaatagcacctttacatgtacaacttttttttttttttaaacagggtctcactctgtcatcaaggctggagtgcagtggtgtgatcttggctcactgcagcctccagctcccaggctcaagcaattctcctgcctcagtctcccaagtagctgcgactacaggtgtgaatcaccactcccagctaatttttatatttttagtagagacggggtttcaccatgttggccaggctggtctcgaactcctgggctcaagtgatccacctgccatttgaaaagaattttatacttccattcactcctgtactccccatttggcaggtgtttattgagcactgtgtggaggacacggtctggtgagagggaggagttggtgaggagaacttccctgcccagggagccagcctggagcagtgagcccaagaagtggacacaggctggatggcggtgtgggctactcaaggaaggaaagcagaccagggtttggcagatgtggaatcccaaagaaggggtagggaaagtcacagcttgcagtggggtggtcggtgtcagccttgtggagaaggctagatgtggacccactctgtctaggggaagggggttcccagcagagggaatcactaaggcaggagcatgcatagcttgtgggaaaacagcagggaggcccacacggctggcacaagagaggggtaagggagcctgagacccctcaggacccaaaggaggccagccttgtaggctgtctggggccttggcttttatcctgagtgacatagaaaagcatcacagggtttgacatggtctgacttcatccatgtctctgcataaggacatgatctcattctttttcatggctgcatagtattccatggtgtatatgtaccgcattttctttatccagtctatcattgatgggcatttaggttgattccatgtctttgctattgtgactaagcactgaaatttttatcttatcctgggcactgactgtagagtaaaggtggcgaaggtgcccacagtagtctcggaggtttaggttctcctctcttgaggatgacatatcctgtttttcagtgtgtgtctgtggcgatacctttgcgttttctttatttttatattctaccttttctctttcttctggtctgagtgttgcctttcagatggagtgctgggagatgctgacttttaaactcttcttttagaatcaagatttactggcacagtcctctcaccgaaggctaggaaagccattgtaacttaatatagcctattaccctaaatctgtgtgtatcccgtgtctatttaaatttgttagagggcaagatattgttaaagctgctgctaggagatttaacttggtgcagtcatgggcctggcaggtggggcagggagacagatgggtaaaccgacggagctagctggtagtgttctaggtaccatagtgccatcagttctgtagagcaatgagagagaatatggtcagctggcatccctgccccaaatgggccttgcacagatctgagggcccagaaaactggcacccaactgctggtgacatcagctattcctttgatgtagactaaaacgttttcattcacagtcttagaatgaaaatagctgggggatgagcactgaccaataggctgtcagctccccgagggcaggggtggggcacagtgcagcctccagagcatcacctgcagcccggtacccagaaagcgtttaatacgtgtttgctgatgaaatagatatgggggttccccccttaggagcaagttttgtaaggaggtaaagggaaagagcctggagtgtcagagtcaccactttcttaaaacaaaatcaagaaccaagaatcagaatcccaaatccagaatcaaagtttagaagctgaaagagaacctttttgccaagagggatggctgagctctgttcacaagggtttcgacttcttctagggttcttttgcttcatttagctctgctgctgttcccggccccagagatgtgctacccacacttgaagattcttgctcaagcccggatgctgttgctgtcacattccctttaatctagcttggatggaccaaggctctcaacactgctctaacaggtggaccagatggaaaataaaacatagcatatatgagcattcaaacagccctgctttcaaaggctgagctaattaccttccagctgtaaaggcctaccataaatgaggtcaccctgtctgagttcctgagttcccaagtcccagtcattggcttgtcctcagatagatggatactcatccattaaggtcgaggcctagagactctctttctctctgaggctctccttccaaattccagctttaaatttgagagatgagcttcccttgatggctgacctccacccaatcacttcctccagttgagctctccgccctgctatgtggtgaagggcctcgaggccagcacaagatgaacacgcctataccacagcaccagagtagtactatatgacgacaggtgcatatcacatacagccgcaggagggctacccatcacaattcctggtgtcacatgcagagcccagcacattcagaagtagagaggaaagaaacatcatgtaaaatcttagggagagaaagctggggccacccaagagagtaaaggttgcctgctttgcagctctgcccgaggcatcgtctgcacgtattatatggtgctggtaatctgaggtatcattgagaggctgtgtctttaaaggggtcacaggaatctcaaaaacaagaagcaaatccattttaattgagttatcgtgggggagtagcctgcctgccagcactccaagctctgtgtgtcccgtatcccaagtcagggttaccctcctaggaagggaggagccctgtctatggagcaggcgggtccagttcctttcttttttgcatgtaaaactctcaaaaccaaggctggctcttcacaggtccctccctcagtctgttgtctgttttcccaggcctttatggagctgtcgttggttcacagatgccaagcagttacatggttaatcctccctccgccaacccccccttcagcaccacgccctccttcctaatgggcctgaacttgccattgtccaaacatgagtgactgaactgaaaactcaactttctgatttaacacacagagtggtttgttttttttttttaaggaaatgtattagattttggctgggttttagtttgtcattatacctgcgtgtaatgttcttctgtttctttttttttcttttcttttctttttttttttttgagacaaagtcttgctctgtcgcccaggctggagtgcagtggcgcaatctcagctcactgcaagctctacctcccgggttcacgccattctcctgcctcagcctcctgagtagctgggactacaggtgtccgccaccttgcctggctaattttttgtatttttttagtagagacagggtttcactgtggtctcgatctcctgacctcgtgatccacccacatcagcctcccaaagtgctgggattacaggcgtgagccactgcgcccagcctgttctgttaatattgcttctcactcccataactttggttcaaaataccatgttcaaaaataccttagttatgcatattttggattctaatatttcaaatagacatggacaattcatttgagataagttgggaattttctcttggccagttaagatattgaggagaaaataacttgatataaaaagtacttttctggatttttctttccttttttttaatttaaagaaggatgacttgggatgtacttgaagcttcttgagagtttgagaatatcttaagatagatcctggttttctcatagtctggtacttgtatctttcactacttcctgtcttaatgttattctacgtgggaataaatgccaacatggcgtcaagcaatgagctgagtttaacacaaaatgttagaggtaacctccttgttctttatcaaaagataagagaagaagagagatccagaatttaaaattttccccttttcctccattggaacagcagctcttctctgaaaacacctcaataccaaagattcttcttaatcacacacatcttttaattaatgtgattttattctaaagaaagcaaatgtctttgactttcagttcaatttctaaaaggggaaaccatgtacttggtccctctgtggggctctttgccattttaatcttttattttctcccaaattatgaatgttcctcagtgagtcttgataataatttctaaattagccttgtctgaacttgtgtttgataatcttaggtatttaattataagtgtcatagattcctagcatttccagtccaggtgtcagattaaaaaagacagtttgacatcctcattgtgcaggtcattttcatcattttccatgccaggagcaaggtaattaatattgctctctcactgcagggacagagtagtaagtttctaaatgttacactttacctatatggatagtgatgcacattctgcttgcaatttctaatgcgatgcccgaaagaatgctatagatggaaagccataccgtggaagacaacgggccaattctcacaagcagcagggtagctaatgtctgctgcattgtttattttacacaatttttgaaaagtgaacagaaaccatgattttaaatttaattaagaaagattatgttggggggaggcaaatcagataatcacatgcacaaagggtttaaaggagaattgtttggacctaaagtcctattttgttgttgattttcatcttccgacaaattgcttcccaaggctctgagttgatttaaagtcaacaggagttctgaatggggtatgaaaataaacaagaatggggaaaaatgggagatttctggatactgattctgaagatatttcacagttaacatttttcactgcttcccatatatttagccctttccaggggatcaaaatgctcataccccatcccattttccagttagaatttcacctgagaatttaaatgcacgatcagtagcttgcttggtgagcaaagatttcagcacaagaagtgactccctgctgacagtggcctgtgagcctctcctggctggatttgtgtctgtcaatcccttgtctctctgcatgggttgtgccccatcaatcttgccaatccctgattatttggccttacctcttttctgagttctggactcattgagcaagtcatacacataaaaatatttactgagcacctgcttgccacaggccttggtcgacaatctttctccagtcaaggcattgtacaagtgatacctgttcctttgttaaatcacatccaagtccctgtcttcctgagattgccccatattgattttaattggattacagacattttcaaagtcatcttagtttgttgagagacagcttacatggcatgtacatacccttgaaactggaaaaaataaatcacatttctcttttggagatttgcaaaggaagacaaagcccaatgaacactggtagaacagaaaacagtttccaaaatccttaactgttattgcccctttctcttttcatggaattgtataattactatcattttatgttatagaaaagtttctagtctatcacatttcatactgtagaaaaacatcattgaatggtgcactttgatggaatttgaaataactagttgttagttttctgatcaatgacatttagaattgtttactatgtgctaagagaaatcaatggtcagctttgaaatatcccaaatcaacgttcttaaatagagaaatacatggcgcctgaatgtttcaaacttgcactaggggccaacagcctcagaagcatcttagacacctcccccaaccatcatcaaaaaaaaaaaaaaaaaaaaaggcatgtattgcaattctcagataaccagtttgctttagatacatgcaagctgcctttggtgcctgccacagctgcaggtctttcttgggagttccatgcggtggaggaaaggcagatcctgtaggccatcggtggctaaacagaggcataaggcagagttggcgattcagccacagccctggaatgacagtgtccccatatggcaaatccctcgcatagaaggccatgggaaatcccaaccagggacccatgatggcagctctagaactgcgttgctctctgacctctctgctagggccaagactggccaagctgctacctactgtgccctggtctgtgcaggtcccctatacattcccacccgaaacttccaacactgagctaagctgagcttgctgtgctcccctcagtgtgaaaaagcttatctcccaccacgtgtcaggagcttcggggaaccagggctgtgtggggatggctctgcctgtgccgagccccgtgcctgtcactgagacatttgagggtccgtttcttgccgatgaggcagttttttaaaaggctctccatctggggacgactcatcctgtgtgaggcaggtgcttaagcacttgacgtgcttgtgaatttcaatagttgcagcagccccagggggtgggaggcgttattggcatttcacaggtgaggaaaccgaggcacagagagctccgtgacttgcccagggtcactcgcgagtgagtggctgaggcagattctgcattctaatctgattaaatccagagcccacatttttaagcacactgctctgcagctccggggtcttttatcactttgtttatcgtgagtattgatacaggagactcctaaagtgatccatggattgaggctgtcaaacatgaacccagaacacgttgtgttttcaatagggtgtcattctttatacacaaagacaacagactcttaattctgccagtgccgcacactgtgagctttttaaaaaaacagcaacaacaaaaaacagcagtgggataattctgcttattcctctgtgttctgaatgggtcacccttgtcttacacccaacagctcatattttgcaatgcctggtatttaaagagtagcttcattaaataaaaatgtgaagtgcgtggcctaaggggtttaggaagagtagaaaaggaaaataaagctgggcactgtggctcacacctgtaatcccagcactttgggaggctgaggtgggcggatcacctgaggtcaggagttcaagaccagcctggccgacatggtgaaaccctgtctctactaaagatacaaaaaatttagctggatgtggtggtgggcgcctgtagtcccagttacttgggaggctgaggcatgagaatcgcttgaacccaggaggcggaggttgcagtgagctgagaccatacctactgcactccagcctgggcaacaagaacaaaactccgtctcaaaaaaaaaaaaagaagaagaaaaggaaaggaaaatttctcacgcatccagtgcatatattttctattccaaacagtaagtgtaattcatcaatttatgggtgggagaatggtttgataaagatggacagcgagtcactgagtcgcccgtgacgatgtggtctgtgcttctgtgtgtatgctgtgatgtattcattcatagcagccctcacatccagttcccatggggtgctgggttctcaggaaatgcatgtgaggatggaagacacgggactagaatgcacatgactttcaggggaaaattgttagttttacagtagatggagaaggaaatttgcttttcatttgacatcttacttttcttcttttcttttttaaactaaatcattataatcttattacaagggtaatatgtcttcaatttagataagttgaaaaaatatagaaagccccaaacttatacagaaatacaaatcttgattttattcttggtccctttatctgaaggttacgtaagtcattttcagaaagacagaatgctcgagtctaaatctcgccctctcaacactcacctccctcgaggaagctgaagtctcggtctccgtccgcgcccccacacactgccttgccaaggggcagcagagcttgcgtggagccccctcctctctcctttggcagggtctcttggtttcaagtattgcctcttgactccaaaatctggattttcaatcctgaccttccatgtaattaatcttcggctgaaaatttcatgctcatccctacttttcactcccctttagatcacactaatgcagatcttgttaccaaatgccaacactgttagaacatctcttaattcgtctccctgactctagtgcctctccttctaatccgttcttcatactgggactagtttaattgttttaaatcccctcatgttctctgatgcctatagggtagtgtgctaacattttaacctggaaataaaaatgctctgctgtcttgcctttatttacctgttcagtttctctttccgattatagtcctgatacggcagaagcatttagtatttactgaatatccacgtgctcccctgcatttcctggcctcccttactggcagactgggctaggatgactgagttctgactaaagggatttgggtagaagtaaggtttgtcacttctaggcctggacataaaagctcctacatggcttttcagtcctctcttcacatttcatggtgtcttcggaggtcatgtgcactttctaagcacattcagaaagtgcagctataaatagtgaagcctccatcagcctgggtccctgaatgaccttgcggagtatacaaacccctgttgacccatggtggatgtgtaatgagtaagaaataattttgtttttgtattaagcctttgagattttatgcttaatttgttactatagcatagtctgtgctatcctggcagaccccacaggaatgcatcttaagtacctcggaattgagccataggcctaatctattacttctgactaagaagagagagttgagacctagtcccagaacttcagttctagaatgaccaattcaatgatccccagattttgagatttcatcaactgggaacagtcaaaataaaaactaagagtttgacaggagttaccaaatgataattttgccaagaaaaggcatttgaaaaaatcctgtcatctactgttacaaccatttcgttaaaaaggacgtataatgtcacatacctcctcccagcagggagaacatacactgtcaaaattaagggtgaattttgtcattgaataaattttgcatcataaaaaatgaaactcttaacaatattgttctaactttctcacttcagtatttcccagtaaacacttagtgacggaagtgctgcggtggggaccagcgttcgcaaagtgcagaagacacggttccccaagtgaagcttgaagacctagaaagacctgagtcaggttttccactgagatgtgaaccagctcctgggggcccctggggtgctgccttgttgaccgcaggcctttaagatctttgtgtaccgctgagacctcttgattctaaggtaaggggtaggaaaactcttgagcacttacaccaaaatgtgtagggggcgggggtgtgcgggctcacgggggtttacacatagctaataggtgtcaggggcaggactggattgaacctcagccccactccaccatctcggtgccattccactctcgagagattgaagactcagagctgcagggaaaccaaacagagctacccaaggttcctggaatggattctgccagggtcctcatttggtgactgtgttgctctccccaggccctgggtgctgcctcaacctgcttaggtccttccaggctcagccctgggggtctcttctcctgggaatgtcccctaacccccatgcaaaggctcaattctttcccctcatgctctcacagcatcctgcatatacagttgaccctttaacaagacaggggtaggggtccaaccccttgtgcggtcaaaaatccatgtataacttttgactccacaaaaccttaactactaatagcctactgttgaccggaagtcttaccaataacataaacagttgattaacacatactttgtgttatatttattatattctctattcttacaagaaagaaaactggagaaaaaaagttattaacaaaattacaagaaagcctggttgtggtggctcacacctgtaatcccagcactttgggaggccaaggtgggcagatcacttgagcccaggagtttaagaccagcctgggcaacatagcaagacctcacctctacaaaaaatacacataaacaattagtcaggcgtggtggcaggcatctgtagctccagctactcggaatgctgaggtgggaggatcaccagagcccgggaggtgaaggctgcagtgagctgtgactgcaccactgcactccagcctgagtggcagagcaagactctgtgtctatttttaaaatacagaaaaagagaaagaaaatcccaagaatgagaaaatatatttacaattcaggtgaattataaatacagttgtccctcagtatccaagggggattagttccaggactcccatgggtaccaaaatctgaggatgctcaagtccctgatacgaaaaggtgcaatacttgtacctactcacatccttctatacacacacactttacatcatctctagattacttataatacccattacaatgcaaatgctatgtaaagagttgttatcgtgtattgtttagggactaatgacaaggggaaaaaagtctggacgtgttcagatgcaattttcttttcaaatattttcagtccgccattggttgaatccatgcatgggaaacccacagatatggagggtgaactgctcctctagcgagttttgtacattaagtggcagactcaggttctgccgtgatttggcttctgttgcctttcagcattgttgaaagagcaaaagattttcgatttcctcttcttgccctgaacatgggaatcatgactttctcttccccattgcaccttccaagactgggacttggaaggagggacagaagcgggagctctgagttaggccatcggggcccttgctgggaagctttgccttgcgtaggcttcatgagggatggcctactcgctcctctgagtggaaagaaatctgagaaggggcaagtctcaggattagcgcctcaccctgggctggccccatgtgtggaggaggtgaccagctgtgtggggcaggggggaaaaagacctcacagccctgcctcaaagctccctcctcccgcattctagtgagatctttcaggcattagttccctgcccaggggcagttaacgcatcaccactcagcatcacctgtccaggaaagggcattgcagagcagagagggaggaacagccatctgccatctgtggagcacccaaggcctctgcctaagccctctccatagcagaggacttcctgagccctggtgagaggcagggaaggctgggctgggagagaacgcttctggagagatggctggaaaggaaagaagagcccccaaaaccaggcacaagattaaatttgctcccagcacatccttctgaaaactgccgtatcccagggccctgttatcatggcctaagtatgtcaggaaatccttgaaacagctccatgttgcacttaaaaccttacacattgcattgcctgtcttccctgctgggtttacatgaaaccagaacacctggtcagtttagtccagcagataaaatttgcatccatgaccctggcccgttctctcctctctcttcctgctcacactcactcacgcaacggtccactgaaagtcttgcttgagaacccttggattttctccctggtagggtcttttaatgcccaccctgcccctctccacagtttatagacaaagacggtaacaaccacgaaattcaagtcgctggttggaggtcccacacctctgaaggactcaggcctgggaaattaaggagccctggtcctctcccatcactgacggatgtccagttccaaatatgttgtcctggagccagaccccttttttgactaataactgtgtcctgactctttttttttccaaatgaaaatgactatgattttatttgttcattaacagttttacaatactgcccagttgacatccagaatcctggcagaggaaaaaaagcaggtagacaaaaagcatcacgttttcattttttatcatcattaaatgacctcaaaattattttatatttaagttactaaattattttcttgtcgttaattatgatttgcagaggtagaactcacatagcataaaattaaccataaaattaaagtagaccattcagtggcatttagcaattcacagtgttgcgcaaccatcacctctctctagtttgaaaacattttcattccccaaaaggagacccactaaccatgaagcagtctctcttcattcccctcgccacggcccctgcgttttgtgtcctttggattcccctatttcagatacttcataagaatggaatcatacagcgtgtgaccttcgtgtctggcttctctgataattatcttcatgtactgtttggtacattagtaagtagacgaagtggaaaccagtaaacctagtaagattattaaccattccctccttagccccgtgtgcagggtatggcgggaccttatttattcttggcatctcccttcaccttggcaaaatagtaccagtgcctggtatgtgctttattattattactattattattattaatggactttatttttagcagagatttaggaaaattaagcagatagtacatagagttcccatatagtctccatggtcttcacaatttccctttttattaacattacattcgagtggtacatttgtcgtaattaaggaaccagtgctgatacattattactaactaaagtctagtttattcacatttcctgagttttttcctaatgtccttttgcggtcctagaatctcatccaggacacgggattccacggagttgtcacgtctgtcaagctccgcctgtgccagtttctccgacattccttgtttttgatggtacattgacggttttaaggagcgctgctcaggtgtattgtaggatgctccgtgactggactgtgatgcatttcttatgattaaacaggggttatgggtctttgaaagaaaagtcacagaggtaaagtggtattttcatcagaccccatcaggggcacatagcaacataacttatgactgttgatactaaccttgatcactggcttagtagtgtttgtcaggttcctccactgtaaagtttctcttttcccccttcctgccttttcttgttttcaaaaagccctgttcccatgattatgcttctgtaatataagcaggtggatgctttgtgtggatacagcagcctccaaggtttggatggccttgttgtctgcttagcagtgcaggatcacccagaggctgtgctgcgtgtgctcagagtcttccacagccacagtgtcatgtacggggtctggcccacaactgacagggaatcagaatttccaatgggatgtcaaacacatagccaatagtttctttctgcttaaattcttatttaacagtcttcccagggtttttttttttaaattttcatttaaaaaatcttttcaatttttttttgtagtggcaaggtctccatagacccatagtccattgcacagactggtctccatctcctgggcccaagcaatcctcccaccttggcctccaaaagggatagattacaggtgtgagccactgcacctggctgcactcttccaagttttatcagtcatgaaatcacagccaatgggaacaagagcatgaatgcaggaggaggtaggagaatcacattttcctgtgttcagtcaacaaacattgctgacaacacgcctgacattctgcaaggacaagtcatctggacaatgatgagcatggatggcccctctgcggtgtcactcacaacccttaacaaatctatttcatacatggcagatgatgggagccctgaaggtacagctccaaaattgttgcttccatgaaggttcaaatgaaccagggactaactctgggttcttgacacttggatttagacataaacttttgcctgtatgttttcagagatgaagaggaccaagacacacattcagatgggggtgagacaatgcccgttgtcccttcagtgcatcagtcacttccagtgctcttcagtggaaactccttgaagccggcactgtgccattaatgtaattcctgaaaagagaggaaaataggcacactgccttggcaaataagatggagaaggaagtgaatacagttagctgggtagtagggatctgcacacgattatatggaaaataactttctgggctgcaagcttcaaaagctcaggacacagccctggaagaggtgccaggttgcaagagggaggcatgcaccggactttggaccccagagtgctgcctttcctttctccagccacgcccaccctgcctgttacagcacctgagcatgaggacagaaagaaaggacggggcagagggggtggggaggggtgtgtctgtccactgggccgggcagtttgggtctaggggaggctgttctagggctcctttgaaagcacaggtaacagatgacaagcagcacacaaaagctattgactagtccacacacttagaaaggtggaaaagaggaaatgcatattttcagtagaagacaaaacaatgtcccagtggctggtcatcctcatggatcgtcacggtatgagcaccttgtacagggcatctggtctgccgagagctgtcagagccattttctcagccaccttttttttttcttcctttttttgagatagggtcttgctctgttgcccatgctggagtgcagtggcgcaatctcagctcactgcaacctccacctcccgggttcaagagattctccctgcctcagcctcctgagtagctgggattacaggcgcctgccaccacggctggctaatttttgtatttttagtagagacaggctttcaccatgttggccaggctggtctcaaactcctgacctcaggtgatctgcccgccttggcctcccaaagtgctgggattacaggtgtgagccaccgtgcctggcctcaaccatctttaagaataagcgtttaaaactggccagttccttttggtggagtgacaaaacctgtagtcacagagacatttggagcagacgaaggcttgcatctcgacctccatgcctagttttctacttgccactgacggcaaggaaacgacggccaaatcacaacctccttatgtttgggtactttgcagtcactgcttataatagagttcagtctcttaagaaagtgtgaaatgaacattgtcttgagtttctgcgaacgtctctggtccactggtgatcaatttgtccaagtttgcctggctttagcaccaaaaatctcacctcttgggaaccccagtcccaggaaaccctggcagttggtcaccttgcctcccagtcatctgctctgagaatcttcattttaacaacttgactcattagtaatctggattccttgtaatctgaaagtattaaattagtcgagagtgtgtttctttccctgctcttgcgaaggcagtctaatgaggatatgagctctaggcatcagctcccctggaaaaaggcgtaacataccaagggtgacatacttttcaggaaccctaggtgaaaccttgaaggctactgctaacatgtatggatgcagtaacacctttttccagaatgcagaaaagctaagacttgggaccagagaaattatggtagaaaaattggaaagctcctgacttgtagctgagttgggaaatgcttgcagaggaattcctgggagaaaccgaatgatgtaagggtcccccatacctggaattgatgttcagaaaaggaagaaactccaccagatggggagtgggaaaggttgtatgttccagtttttagctgagtcttatttgggattatcaccatttctgtgacttttgaacagctttgacctccaggacagaccaaatggacccctctgattttctcagaattgtagtatttatttatgtctatatcatatctgcagacatgtattatgcaggtttcctctgctgtgtttcctcagctgcagtttcataatttattctgccaggctcagcatgtccttgacataccaaaccattaactgaaaatcagaaaagttctgtgaggtcgctaaattctttcttctgatgatcagcctgcacactagctgaaaataaagccactgggctggcagacaaaaaataattggcctaaatggtcacagaaaagtctaaacagaagattttctttccctcttcacttgcaatgatttattttcgcggttttatgagactttaatgaggaaaccttatctgtacgcctggtaattatcaaccaaatttccatttcctgccagaaaatccacaataagcagaacaaaaacggtggaatcgggagactgtttggcctctgacctgtatggctggggagtaactcattgccacacagagcatgtgactagcaagcatgtctgtgacttctcttgtacacttttgcttaaactaaattgccacattcaatttagtataactcagtacacgtagactcagacgccatgaagcatcccggacactgtcccatgaggtggcatttgggcaagagaaagtacaacttccctcttcataatttaatataatttctagtctcatccagttccttctgttgggtgaatgaggtcatacctgacatgagggtctgacaagaggccatgaactttgcatcttggaaagttgggtttttcaacatagattgcagctcttgcctatgagtgatgatgctacaattggggtcactgaggaaagctgctgtgggcactgactccagacttagcggtgtggatgtcccagcatcctgagattcaggtggagagcttgtcgatgccatggcaccggtctctgggacctctagaacagaaggtacaagaggggagctcaaatgagcacgccagacagatggaggctgtgggagttgagagtctttgtagaattgcagggtactgcagcacccacagcagccaggaagtcagaacgcgtctgaatcttctgttctagtttagttaacaaggtgagaatccttttttttttttacacttttctctaggtgtaaaatttgtcatgctctgaaataacctacaaatttatctctgcctgttctgtcattgaaagaactttgctcatgctttaattgtgtctttattggcatttgggggccagtgatgaaaaaaaacctgaataataatgtaatgacttattttaaattaaagaaatacttcccaaaaatatttctcaagtcaccgcaggtaacactgggtaggtttgtaccaggtgcaagttctactccaggagaaaatgaaatggcccaaatttgctcttgccccctctacagcaaggagtatgaattccttcactctgtctctgcgtccatccccatcctgcccttccccatgggacatgggtaggagtgagacgccgggagctagaggctactatacagcatgcagtggccacaagctttgggcattgcttggtttttattatcttttcagttattaatcaatgtatgtcctttgactccttctctatattgcaggagtgtttatatttggcaggcttcctggactagtgaatgagctgggccagggctgtctgctcttcgtctttcttgaggggccattaccattaagtcacctgctatgacggcagtgtagaaggggctcttggcacaccaatatcctccagaaggagcacgctccaagatcaaggcgttctatcagttaagacccagacggtgtcctgatctggaacagtgctgtctaatagaaatataatgagagtcacataagtaattttcggttttccaaaaatagtgacatttagaaaaggatcaggaagcaagtgaaattaatttaaatttattttatttaacacgacatgtccaaaacattattgtttcaacatgaatgaaataagacatgaaatatttgagacatatatgtatatatatacacacacacacgtatatgtatatatgtatatggtatgaagtccttgaaatctgatgtgtattttatacacacattaaatctcaattctgactagccacgttttaaatgcttgatagccgcatgtggctagtggctactgtgtgagacagcatggatctagaatgtttatttattccaactaactccatagcctcagttggttgccttttgttgccatgagtatgtgagtgactgtacttagtcatggtggacactttgccccacaaaattgtgcattccctgccgtctgctattttctctccattgtctcattctggaccaaaatttagagctagagttagaattctggtagtcccagctcttctgtgccttcagagaatgatgtgaccgttagttcaccacaaaccttcagaatggaaagtttagactgctgattcccaaagtgtggtaggagtaagaattcgctgattaaaatgcagattcctgggcacacctccagatgcactgatgataatttctggagatgaggtctgggaatatgccttttatcaacatcaccaggtgatctaatacacgtcagagtttgagaacactagcatagaccttccactgaggatggtttatctgggaacttcgggttctttctcactcagtctttgttcagcttccagcgacagacagcccccgttctccccttggcaaggctgctgctcagtcgctgtcccatattttataatcaccttgctcacagtcagccgcatgcagagacctatataacacccagcaactgagaaaccgctctgcggtgtatttttaagactggaactctccttttgagcttcttccctctatttttgtgtgtgccaagatagctctgtatggtgcagcacctgaaacttagccacttttctgtcaagggcttttaggatatttataaacaccttctcgttaatcttcattgcactcctgtaaaataaataacaagtgagattgccttcgttttgcaggagggaaatcgaggcatcagatagttgacttgtgaagacactttggggggccaaaataagtgattaaatcacttttctttttggcagccatgcccgtgtgtgccccttccctgaccactaaactcttgtggtcactgaaacccatggggaagaacttctgataaaagcattttcctgaagatgctgcatgtgtcagcatcttgcctcaggtgacaagatggttgtttccgggctatgctggaagacttgaggcaggaggtgtgctgttccatttcatacttgctgtggtttggatctgggtccctgcccaaatctcatgttgaattgtaatccccagtgttggaggtggggcctggtgggaggcaactgggtcatggggatgagtgtctcatgaatggtttggcaccatcccccttagcactgtcctcagggcactgagtgagttcttgtgagatctggttgttgaaaagtgtatggcaccgtcctcactcactctcttgcccctgctctggctgtgtaatgtgtatgctctcccttcacctcctgccatgatcgaaggttccctgaggcctcctctgaggccaagcagatgccagcatcatgcttcccatacactctgcagaaccatgagccaattcaacctcttttctttataaattacccaatctcaggtacttctttatagcaaggtgagaataggctaacaggatacttctttgggataccgtgtcttctggaaagaagttatctatagctcccaagtccctgcagcccagtgatgagcatttgaaatgaaagcgtggaggtcttgtcctttctctctacctctgcttcccagcagggctgacagagcatttctcactcagggccatggcagccacagggagggcatcgagtctcacacggggatgctgggctgtcgtttcttaatgtagtccaaagccattgctgcctgtagacttgaggaatctttctgtcaagagagaggagtgtgtgcagagcgaccccagagaaggatgcctttcagcaatgtttgaattgctgtgttttgtttggctgctggatgatcctttttcaaaacatatactttaatgcaggtattttatatgtgtgttttcatactataatttccttctctgtctttttgttttaaagctcttcttttttaattgtaggttcattttgatcgtaagttcattatagaaatttgtaaaatacagaaggtataatggtgaaaattaaaattacctacagtcttaccatccacagagataaccactactattttggtgtgttttctttagttttttccttgctttttaaaaaacatatttgacatgaccaatatgactaaaaaccagctttttcttctagaaaccttggttcatttcttggacagtgatgtttattcacagacctggtgtttgagaatgtcaatgggtatgtaattgtttctaggtctttttggtgaagacagctagaaaatagatatttaaatataaaatctccatgagtttttactcttattcttttacttttttacttaacctcttctattttatatctgcatctcctttctttcacactgagaagtctggttctcaatgacacaggaatgatatatgtattagtccattctcatgctgctgataaagacatacccgagactgggtagtttataaagcagaagaagtttaatggactcgcagttccatgtggctggggaggcctcacaatcatggcagaaggcaaaaggcatgtcctacatggtggcagacaagagaggattgagacccaattctctcaattgggtttcaattgagagaattgaaaggggtttccccttataaaaccatcagatctcatgaacatgagaacagaatggggaaaactgccccctcattcaattatctcccactgggtccctcccacaacacatggaattatgggagctacaattcaagatgaaatgggtgaggacacagccaaaccatattaatataattagaatattccatattaattcatatgctttattctatattacttatacaatcatctcagaataacagtacaaatactcccatcaccaatgtgattactgaaaacagtgtttttactacatatattttccctatttatccttcccccattttaaaatgattgtactatgtctacactgtcaagacacaaccactgcatgatgtatgctcacctctgttctgtgtggactgtacgtttactgttcattaccagaactcatatcaatgtttctctggtcatttttattgtctgaatcttgttctctagtagattcttcagaaaggatccatgaggacaatattttctaaattctttcatgttgataccagtatgtaccttttattcttgagaaaatccattttgctggtcataaaattcttggttcacattttctttccattagtatctcaaacatgttagtccattttcttctgccataaagcattgtgtttgaaaagacttttcattataaattgcttcctgtttttgcttagatgcccaaaaaagatttttccttgtcttaaattcaagtctagtttggttttggtatttgtggttctggttgatattcacaggtatgtggcatgttcttttagtgtgtagtctcaggttttttctttttaatttcaggaaagttttcttgctttgttggcttcccagctcattttcttgtactaacaatatttgaggatcatctggatagatggagaaaataaagaagcctatggtgctagtaaattcactggattggggctgtccactctagttaacaaccttactgatgcccaagactatattatctttcatgaacttgtaaaaattgatgtgaagccatcagataaagatgtgcatgaagaagacatagagaacagaggatttgaatacccacaccttccagcaccacagattaatgattgctttcccaaatatacctgttcctgtcccagtgggtacaatctaaaggaaaatggcagagagtgtcaaaggatcactgtgaccactctggtatcaaaagtcagtgttcctccaaaggagacttctcctgtctgggtcatccttcctcttttgctctaagcaatggcagcagtaggtggatacttgagtggcagaactggcaacacaagaacataaaaggtgtgatctttgacaatcctgtgtacttgaaaaccatggaagaggacctcttaatggacatgggtagacatggtgcttctggtggatgcacgtgcccagtaataccggtcataagcacagatgatgactcagcttgacttctaagaccaacttagaagtctcgacttctgaggtccacatcaataattccctactttggaagggtaacaaagccagaagatgaggccgtttcttcctccagcctggaggaacctcacgatatctctgttgtggataaagcttgtgtatttgacccttgctgtggtttgagtttgtccccatcaaaactcatgttaaaatttggcccccagtgtagcggtgttgggaggtggggcctagtgggaggtgtttgggtcatggggtgcaatcctcatgaatgctttcaactccttccttcttcacagacactgacatgatgcaggccttatagctattggtagcttgaccccatctacttgtatcttggggttcttggggatactttgtcactcagttttgttataaatgtctgtctggttgattttgttgttcaatatttttaatatggggattcagggagatttaaaaaaaacagtctctgctgccattattaccttcccagaatctctttcaactttatttctttttaattaaaaatgagcataatgagcctggggctctgtctccaccaggcacatcccctgccttgcacagctctcagttgatagcaggttgctcttcctctggtgctcagagctgcatttccacagatactatctcagtgcccacccataagccaccatttcttttccatatccttaaagcagatcacagccgtaatgagctacccacacacattctccaggggatctctaaaggtgccaattgttatttttgtcaatgctttgattataaaattgcacaggttttgagacacttattttaacctcattttttccataaaccctatgacatttagtaacacagctttacagaaggtgaaaattttcagtaaaacatatctcatgttattacagaaacagatgcatgtattcatgtatgacacatatgaaagagcacttgaaatcattaaagataaatgtatagaaaactacatgagtgaataaaacaggacagttgctaacccaggaaaaaacacatggtattaagaaaagaaataatcactgcaaagtgaacaatgttgacataatcataatatttgaaacactgattatcactctaagtacaacttgtgaaataatcacagtgagaggaaaagatgagtgcagcgggcactaggcgtcaatagatgctgtccaaaaatgtaagaaataatgtcataaacatattgattacagacaaaacatggagatatataccagaagaaaaacaaaaactgctaaaagatcaaacccagaggacttaaaggaatggaacagggagttactggttttttttttttttttttttttttttttttgaaacgaggtcttcctctgtcacccaggctggagtgcagtggtgagatcttggctcactgcaacctctgcctctcaggttcaaatgattctcctgcctcagcctcccgagtaactgagattacgggcaccaccatggccagctaggttttttgtgtgtatttttagtagagacagagtttcaccatgttggtcaggctggtttcaaactcctgacctcaaatgatccacgtgcctcagcctcccaaagtgctgggattacaggcatgagcctctgcacctggcttgatttctaaaatatgtacatgcactatttcgttgttaataatttgggaaaaaaacattttaaaaaccatgctgaatacaaggttatgtacttttcaaggttcttatattaagtgccaaattgttctcagaaaggatacattaatttaacattgttgagatcatgtatcacctctgatgtgtcattccatgtggatggaattccatcagggcaacacgcctgacagctccctgctgcaatttgaaaagaacctttgccaatttcatggacaaaattagcatcttatttatttacaattttgattacacttgaagttatgtgattttaaaaatgtatataaactatttgtatatagtaatctatgttctttactcatttatttactgagatattaatcattttctttttgattcataagagttttttaaagattaaggaggttgagcatggtgactcatgcctgtagtcccagcactttgggaggttgaggcaggcagattgctcatgcccaggagctggagaccatcctgggcagtgtggcgaaaccctgtctctacaaaaaatacaaaaattagctgggtgtggtggcgtgagtctgtagtcccggctacccaggagcttgaagttccaatgagctgtgattgcaccattgcactccagcctgaatgacagagcaagaccctgtctcaaaaaaaaaaaaaaaaaaaaaaaaaaaaaaaaaaaaaaaaaaagaggaagaaagaaatggaaagattaaggaaattgaccacttattatatttactataaatttttccactttgctcttttcttgtttaagaatcaattcaacttaaatttgcttaatttttgacacacagaagttcagaatttttatacttctttttgtggttgctgtcattatttctcaagatttaaaagttcatcttctctctcccaccacccatactggcatccaaagttttgatgaaaaacattttattaccacacttgacttggatagctgccttttgctgggataaggacattctgcatttgcaggggagaaaatagacaatacttctgtccgccatcatgggcatgcctatgtgaatgagctccagaacctctagaagtgattcagagaagagcctcatcaaccctcacactggctgtcctgtggctctgctggcccttcccagtctttgagaatcccagcagtggcagctctgttatgtgttattggtgctgagccggccctgagagctgctttcagcatggcctttccctacaaagtaaggggtctgaccctgcatgacctaaaagcccttcattaagtatttgcttaggacattttattgactctaaatagctctctcaacattaagttgtctggtccctgctggacttactatgatctgtgttaatttgtttgctagattgaattttcttagctcaagctgatgaataaaataggtgagacagttttccccaaagacaaataaaatctcatcagccacagaattttatatcttgtggctcagaagaagacctgctgcctctctaactacactcccccaaatattgtgttctggctacgccaatgagctgtttcttgttttgccagtagatacttctgatcaggactattgcaaacggtccacagcatggctccaagtgagttgtgattcactctaaggagtgttttcatcttcagtgtggtttgtttcaaagccgaagccattttctagcccttttttggttacattggtattaaaagtactaaagaacttgtagcatgctgcattagatgtgtttatgcaacatagcagaacacaattaatttcccaatctgcacaaattctaatattaaaattatgtaaagtgtaaatgctccctttggattcttaaaagggcctaatatctactaatatttttcttcttttattaaattttttcctgtttttcattcctggttgaacattataatcacgtgggaatttttgttaaatatcagcacttggccccctctaggccttctgaatcggaatctgcagggtggagcctggacctcagtacttacaggtaatgtcctccagtaattttggacagccaagtttgagaactagtgactctagttcaaaaattttaattcattatgactatcatacaatacccatagagagacagcaatcctccttaggagtgtatagaggccatctgatgggagctttggggtcatctgaaaatagcatgtgggaccactgggggacagcttggtgggggatatgccgagggtatgtctgaagctgttcgcaaagcaagcctcctgtttggacttatttgtatcagtccatttatgctgctataacaaaataccttagactgggtaattgataaataagagaaatgtattgctcacaattccggaggctgggaagtccaagacagaggcatcagcagagtcagtgtctgcagagagcctgttcctcatagatggagacttctttgtgtcctcatatggcagaagagggcgagggcgcttgttcaaggctttcttacgatgcaggagagaccctacatcaccctcgtgatgcagggtaccacctcgtcatcataaggaagagacctcctcgtctccttttctctggacctgcgcccctgccctgtctgccactcttccacatctgtgggagtgcaggaggtgcttggagcaccccctccttcaaagacagggtggaggctcagctccctgcgcgtctgctgacatcaccctggggccagacgttctaaccagcagaacgtcaggggagagaggagaggtggaaacaaggttatttccacttcccgatgctgctgaaaggtaataaaaggcaaatctgactctgaagatgtgagaaggaaggagatgctgagtgggattcttcctcctccatatgctaagtcttgggtgttcaggactcagctcctttctgttgtctcttctaaggtgtaggaaaaatgacagtacaagtgtgtaccagagtttagttgaaaagttgaactaagtatggtaaagacagagctcattcatcttttcttctctctgcccgtggctccactccctttagtatatgcctgaagagggaggctgctggaacgtcagaaagaaacccctgccctctggatttcatgtcatgcagcctgtcacttctccagttctgctactctctgcaaaacattttctgcatccaacttctccaacccatccctgctctgaggagcactgtccaaatttaggtgatcttctgaccagagcatcctaacctgttttgctttatttacttattcaatcattcattcatttattcaacagacaagtatcaactattttgtggcagcctttgttgggtgttgaaggagacccccccaaatgaaaagatactatctcagtgtttgttttgtttacagaataaacttgaaaacaaacggttacaatatagtgtgagttgttttgtgataagcaagacaatagcaagaacctgaaagcgcaccagcattacagaacatctaagatccgaaggataaacgtttgctagacagagtgggcaggacatctggacacaaggccagcgcaagagagttgagaatggcacagccaggggctcatctgtgaaacttgtcagggagcatggagagatataggggaagccaagccccagaaatgagttggaggcagaatttggaatttcagtttataggaatgagagagataaaggtggctttgaagcaggtcagcaacctgccgttgctgagagacaattctacaggcaaggcaaagagccgactgcagcggtacgtccaatggccaagagtgaggtcctgaaggaggcagcaggtgaggagaccagcaggaacacgggtcactgagcttcctgttaccagcccctctgcgtgaaagcaggttccttctttcattgcattactcctgttttccctgaaatgctctctattcattgcctgttgcaacaggaacattttgtcccatagacatgaaaattcaatttgctcagaaatgcaagaatgtggcctggcgcggtgattcacatctgtaatcccagccctttgtgaggccgagacgggtggatcgcctgatgtcaggagttcaagaccagcctagccaacatggtgaaaccccgtctctactaaaattacaaaaattagccagccgtggtggcaggcacctgtaatctcagctacttgggaggctgccataagagaatcgcttgaacccacaggcggaggttgcagtgagccgagactgtaccatagcactacagcctggggaacaagagcaaaactccatctcaaaaaaagacaaaaatcaaaacaaaaatggaagaatgcaatgatagtgtaagttctttgaggacagtaaccatatttttctcttctgtgtatccccagaatacagtacagtaactgatgtgaaggaggaattccatagatttttgatgaggccaggcgcagtgggctcacgcctgtaatcccagcacttaaggaggctgaggtggaaggatcccctgaggccagaaattcaacatcagcctgggaaacatagtgagaccccatctttacaggaaatttaaaaattagacgggtgtggtagtgtgcctgtagttccagctactcaggaggttgaagtgggaggatggcctgaatccaggagtcggaggctgcagtgagctgtgatcacactcctgcactccagcctctgggcaagtggtagtttgtggtagtttgttatggcagccgtggcttgccagcaaccactagaagctaggaagggacaaggcgacagagtgagaccctgactcaaaaaaatctttgatgagctggattgactcctgaataattggaagggtgtgttagcctcctgcggccgtgataacaaacgaccacaagctgggcagctttaagccacagaaatcaaagtgtcacagggtcacgagtcatccgaaggctcgagtggagactccctccttgcacctccccagcgtctggtggttgctggcaagccttggtattcctctgctggcagctgcactgctccagtctgtgtctgtcacttccctgccttcttctctgtgtcactgagtccacatttccctctcctttaaggacaccagtcattggatgaggttccaccctaatccactgtgacctcatcttaattggattatatctgcacaaaccctatttccaaataaactcacattcacaagtaccttaccaggggtaaggatgggaacatatcttttgggagggccgcagcttaactaacaaagcgtgctgtgtgtgctcttcttctgtatctacaggtctgaagcttctttggagggactccttccacatggggcaggttattccggaagcagctccagaacttcaaataattatattacacagtcagcacaccgttttctaagggctagattcatgcattctttcagtgtttgagggcctgctgtgtgctgatgctgcttcaggatctggatgtggagagatgagtaagccagacagctctgatcaaatacaattgtttgtgttttaaacttgccaagggcatcatggactcttctggcaattacatgattaaaacatagttttaagagaaaggaaagtcatcatttttctttttgccaagatgtaaactaagatgcatgactgggaaaatgtcatcttataggatcatgcctatggacaagggcttatggcaaaactgtggagctcagcttggagtgccccgaatctgagcacagcaggatgacaaatacagaagcaaggatgggtggtctgtgggaggggagatgaaggggagttgcgggatggattgcagtagtgctgggggccctgacagtggatcaggccaggagtcctcctgagctgtcctggtggcccctggaaccaccaatgtgatggaacttctcctggtccagtgagcaccctgggtggtacaggaaagaaacacactggagcaggcattccgcactcagggaaccaccccaggacagctgtgtgtttgtgccttcttcctcttcgtggctttcctcgaaaggtggcatggcctcaggctgccatcacacccttcttccccttgggccttctggcctgacactccgtgtgcctccctgcctgcctcctgcttctga
